US011987607B2

(12) United States Patent
Yount et al.

(10) Patent No.: US 11,987,607 B2
(45) Date of Patent: May 21, 2024

(54) ANTIMICROBIAL PEPTIDES WITH ALPHA-CORE HELICES

(71) Applicant: THE LUNDQUIST INSTITUTE FOR BIOMEDICAL INNOVATION AT HARBOR-UCLA MEDICAL CENTER, Torrance, CA (US)

(72) Inventors: Nannette Y. Yount, San Juan Capistrano, CA (US); Michael R. Yeaman, Redondo Beach, CA (US)

(73) Assignee: The Lundquist Institute for Biomedical Innovation at Harbor-UCLA Medical Center, Torrance, CA (US)

( * ) Notice: Subject to any disclaimer, the term of this patent is extended or adjusted under 35 U.S.C. 154(b) by 0 days.

(21) Appl. No.: 18/053,981

(22) Filed: Nov. 9, 2022

(65) Prior Publication Data
US 2023/0227516 A1    Jul. 20, 2023

Related U.S. Application Data

(62) Division of application No. 16/612,242, filed as application No. PCT/US2018/032133 on May 10, 2018, now abandoned.

(60) Provisional application No. 62/505,013, filed on May 11, 2017.

(51) Int. Cl.
| | | |
|---|---|---|
| *C07K 14/37* | (2006.01) | |
| *C07K 14/435* | (2006.01) | |
| *C07K 14/46* | (2006.01) | |
| *C07K 14/465* | (2006.01) | |
| *C07K 14/47* | (2006.01) | |
| *G16B 15/20* | (2019.01) | |

(52) U.S. Cl.
CPC .... *C07K 14/4723* (2013.01); *C07K 14/43518* (2013.01); *C07K 14/43522* (2013.01); *C07K 14/43568* (2013.01); *C07K 14/43572* (2013.01); *C07K 14/43581* (2013.01); *C07K 14/463* (2013.01); *C07K 14/465* (2013.01); *G16B 15/20* (2019.02)

(58) Field of Classification Search
None
See application file for complete search history.

(56) References Cited

U.S. PATENT DOCUMENTS

| | | |
|---|---|---|
| 5,607,914 A | 3/1997 | Rao et al. |
| 7,739,055 B2 | 6/2010 | Stephanopoulos et al. |
| 7,807,876 B1 | 10/2010 | Navarro et al. |
| 9,133,257 B2 | 9/2015 | Yeaman et al. |
| 2010/0076173 A1 | 3/2010 | Stephanopoulos et al. |
| 2015/0232521 A1 | 8/2015 | Yeaman et al. |
| 2017/0121384 A1 | 5/2017 | Yount et al. |

FOREIGN PATENT DOCUMENTS

| | | |
|---|---|---|
| KR | 20030061718 A | 7/2003 |
| WO | 2016197049 A1 | 12/2016 |
| WO | 2017048092 A1 | 3/2017 |

OTHER PUBLICATIONS

NCBI sequence XP_008893305, available 2014.*
Database UniProt [online] Accession No. G1N9U6, "RecName: Full=Interleukin-5 {ECO:0000256:RuleBase:RU363136}; AltName: Full=Eosinophil differentiation factor {ECO:0000256:RuleBase:RU363136}," Oct. 19, 2011.
Database Geneseq [online] Accession No. AAP60411, "Exon 4 of human interferon-gamma," Mar. 25, 2003.
Database UniProt [online] Accession No. W2G110, "SubName: Full=Uncharacterized protein {ECO:0000313:EMBL:ETK76743. 1}," Mar. 19, 2014.
Database UniProt [online] Accession No. W2Y3P7, "SubName: Full=Uncharacterized protein {ECO:0000313:EMBL:ETP29352. 1}," Mar. 19, 2014.
Database Geneseq [online] Accession No. AAM05438, "Peptide #4120 encoded by probe for measuring breast gene expression," Oct. 9, 2001.
Database UniProt [online] Accession No. W2Z9T6, "SubName: Full=Uncharacterized protein {ECO:0000313|EMBL:ETP42979. 1}," Mar. 19, 2014.
Database UniProt [online] Accession No. A0A081A496, "SubName: Full=Uncharacterized protein {ECO:0000313|EMBL:ETO73707. 1}," Oct. 29, 2014.
Bairoch et al., "The SWISS-PROT protein sequence database and its supplement TrEMBL in 2000", Nucleic Acids Res, Jan. 1, 2000, vol. 28, No. 1, pp. 45-48.
International Search Report and Written Opinion for PCT/US2018/032133 dated Oct. 18, 2018, 15 pages.

* cited by examiner

*Primary Examiner* — Fred H Reynolds
(74) *Attorney, Agent, or Firm* — Sheppard Mullin Richter & Hampton LLP

(57) ABSTRACT

Computational systems and methods are described for identifying new α-helical antimicrobial peptides using a systemic consensus formula. Newly identified α-helical antimicrobial peptides are tested experimentally and show potent microbiocidal activities.

8 Claims, 14 Drawing Sheets
Specification includes a Sequence Listing.

| | P | P | H | X | P | H | H | P | Peptide (Common Name, *Species*) |
|---|---|---|---|---|---|---|---|---|---|
| | 4 | 5 | 6 | 7 | 8 | 9 | 10 | 11 | |
| | K | K | | | K | X | | K | Ponericin-G4 (Ponerine ant, *Pachycondyla goeldii*) |
| | R | R | F | F | R | | F | R | Uperin 3.2 (Toadlet, *Uperoleia inundata*) |
| | H | H | W | W | H | | W | H | Cecropin (*Bombyx mori* (Silk moth)) |
| | E | E | Y | Y | E | | Y | E | Cyanophylyctin (Skittering frog, *Euphlyctis cyanophlyctis*) |
| | D | D | V | V | D | | V | D | Pandinin-1 (Emperor scorpion) |
| | N | N | N | N | N | | N | N | Cathelicidin (Bornean orangutan, *Pongo pygmaeus*) |
| | Q | Q | L | L | Q | | L | Q | Ocellatin-2 (Argus frog, *Leptodactylus ocellatus*) |
| | S | S | M | M | S | | M | S | Ascaphin-6 (Coastal tailed frog, *Ascaphus truei*) |
| | T | T | C | C | T | | C | T | Dermadistinctin-L (Monkey frog, Phyllomedusa distincta) |
| | A | A | A | A | A | | A | A | Bactericidin (Tobacco hawkmoth, *Manduca sexta*) |
| | G | G | G | G | G | | G | G | |
| | Q | | | | | | | | Cecropin-D-like peptide (Greater wax moth, *Galleria mellonella*) |
| | N | N | | | | | | | Pseudin-1 (Paradoxical frog, *Pseudis paradoxa*) |
| | K | H | V | | | | | | Caerin-1.4 (Centralian tree frog, *Litoria gilleni*) |
| | K | T | A | G | | | | | Brevinin-2Ec (Marsh frog, *Pelophylas ridibundus*) |
| | K | H | V | G | K | | | | Pleuocidin (Winter flounder, *Pleuronectes americanus*) |
| | Q | K | I | M | E | D | | | Chemokine Platelet Basic Protein CXCL7 (Pig, Sus scrofa) |
| | H | H | V | G | N | F | V | | Clavanin-A (Sea squirt, Styela clava) |
| | E | K | F | L | K | R | A | E | Chemokine IL-8 (Human, *Homo sapiens*) |

ANTIMICROBIAL PEPTIDES WITH ALPHA-CORE HELICES

CROSS REFERENCE TO RELATED APPLICATIONS

This application is a division of U.S. application Ser. No. 16/612,242, filed Nov. 8, 2019, now abandoned, which is the U.S. national stage application of International Application No. PCT/US2018/032133, filed May 10, 2018, which claims the benefit under 35 U.S.C. § 119(e) of U.S. Provisional Application No. 62/505,013, filed May 11, 2017, the contents of each of which are incorporated by reference in their entirety into the present disclosure.

REFERENCE TO AN ELECTRONIC SEQUENCE LISTING

The contents of the electronic sequence listing (254302.xml; Size: 8,630,846 bytes; and Date of Creation: Oct. 25, 2022) is herein incorporated by reference in its entirety.

BACKGROUND

Antimicrobial host defense peptides (AHDPs) are an evolutionarily ancient arm of host defense that first arose in prokaryotes as a means to neutralize microbial competitors. Subsequently, similar peptides evolved in all classes of eukaryotes where they continue to act as a first line of defense against microbial invaders. AHDPs from nearly all organisms are typically small in size, cationic and amphipathic, properties that are thought to be essential for their microbicidal activities. Cationicity is thought to confer selectivity towards microorganisms, given their relatively electronegative surface charge and membrane potential. Amphipathicity has been shown to be an important feature by which AHDPs can successfully associate with and permeabilize target microbial membranes.

Given that eukaryotic AHDPs act on rapidly-evolving bacterial targets, they must necessarily react in kind to retain their potency. This host-microbe arms race has led to positive selective pressure allowing for a very high degree of mutational tolerance within AHAPs, which have been shown to be some of the most rapidly evolving sequences studied to date. When compounded over an evolutionary time scale, this process has generated an exceptionally diverse repertoire of eukaryotic sequences and structures capable of exerting microbicidal effects.

The inherent diversity in eukaryotic AHDPs has made the identification of common microbicidal motifs and SARs elusive. While a number of research groups have utilized computational and/or QSAR methods in an attempt to characterize such motifs, they have largely been focused on identifying improved drug candidates. As a result, while these investigations have identified numerous optimized or improved peptide-based therapeutics, the unifying physicochemical and three-dimensional features that confer microbicidal activity to native peptides have yet to be fully defined.

SUMMARY

The present disclosure describes the identification of a consensus formula representing α-helical antimicrobial peptides (AHAPs) from broad classes of higher eukaryotes. When this formula is applied as a component of a logical search method against proteomic databases, it consistently retrieves a majority of the known AHAP families. Furthermore, this consensus formula helped identify a number of putative novel microbicidal peptides, as well as covert antimicrobial activities within proteins for which no such activity has yet been assigned. In accordance with one embodiment of the present disclosure, therefore, provided are microbicidal peptides, compositions, methods, and uses, and computer systems and methods for identifying consensus formulae and for searching microbicidal peptides.

In one embodiment, the present disclosure provides a peptide comprising an amino acid sequence selected from the group consisting of SEQ ID NO: 1-14, and an amino acid derived from anyone of SEQ ID NO: 1-14 with one amino acid substitution, wherein the peptide is not longer than 100 amino acid residues in length.

In some embodiments, the peptide has antimicrobial activity. In some embodiments, the peptide comprises the amino acid sequence of anyone of SEQ ID NO: 1-14. In some embodiments, the peptide comprises the amino acid sequence of SEQ ID NO: 13 or 14.

In some embodiments, the peptide is not longer than 75 amino acid residues in length. In some embodiments, the peptide is not longer than 60 amino acid residues in length.

Also provided, in some embodiments, is a peptide comprising an amino acid sequence of SEQ ID NO:19-6860 or an amino acid derived from a sequence of SEQ ID NO:19-6860 with one amino acid substitution, wherein the peptide is not longer than 100 amino acid residues in length.

Also provided, in some embodiments, is a fusion peptide comprising a first fragment selected from the sequences of SEQ ID NO:19-6860 or an amino acid derived from a sequence of SEQ ID NO:19-6860 with one amino acid substitution, and a second fragment having antimicrobial activity, wherein the fusion peptide is not longer than 100 amino acid residues in length. In some embodiments, the second fragment comprises a gamma-core motif comprising two anti-parallel β-sheets interposed by a short turn region with a GXC or CXG sequence pattern integrated into one of the β-sheets. In some embodiments, the gamma-core motif comprises CPTAQLIATLKNGRKICLDLQ (SEQ ID NO: 15) or a first amino acid sequence having at least 85% sequence identity to SEQ ID NO: 15.

In some embodiments, the peptide or fusion peptide includes one or more non-natural amino acid residues.

Also provided, in one embodiment, is a composition comprising the peptide or the fusion peptide and a pharmaceutically acceptable carrier. In some embodiments, the composition further comprises an antimicrobial agent. In some embodiments, the antimicrobial agent is selected from the group consisting of imipenem, ceftazidime, colistin, chloroquine, artemisinin, vancomycin and daptomycin.

Also provided, is one embodiment, is a method of treating an infection in a patient in need thereof, comprising administering to the patient an effective amount of the composition. In some embodiments, the infection is caused by a Gram-negative bacterium, a Gram-positive bacterium or a fungus.

Computer-implemented methods are also provided. In one embodiment, a method of identifying a peptide having antimicrobial activity is provided, comprising: identifying a consensus formula from aligned amino acid sequences known to have an antimicrobial activity; tuning the consensus formula with a test search against a plurality of proteins with known antimicrobial activity; and searching in a protein database, with one or more processors, for amino acid fragments matching the consensus formula, wherein the search takes as input one or more criteria selected from the group consisting of location of the fragment in a protein, size of the protein, organism of the protein, and signal peptide of the protein.

In some embodiments, the tuning comprising shortening the length of the consensus formula or changing substation options at one or more amino acid residues.

In another embodiment, a computer-implemented method of identifying an α-helical antimicrobial peptide is provided, comprising: searching in a protein database, with one or more processors, for amino acid fragments matching a consensus formula: X-[VILMCFWYAG]-[KRHEDNQSTAG]-[KRHEDNQSTAG]-[VILMCFWYAG]-[VILMCFWYAG]-[KRHEDNQSTAG]-[KRHEDNQSTAG]-[VILMCFWYAG]-X-[KRHEDNQSTAG]-[VILMCFWYAG] (SEQ ID NO:6861), wherein X denotes any amino acid residue; filtering the searched fragments based on presence of a signal peptide in the respective protein; and evaluating the searched fragments for one or more criteria selected from the group consisting of: hydrophobic moment; mean hydrophobicity; net charge; frequencies or ratio of K and R; and isoelectric point.

BRIEF DESCRIPTION OF THE DRAWINGS

Certain features of various embodiments of the present technology are set forth with particularity in the appended claims. A better understanding of the features and advantages of the technology will be obtained by reference to the following detailed description that sets forth illustrative embodiments, in which the principles of the technology are utilized, and the accompanying drawings of which:

FIGS. 1A and 1B show graphic representations of α-core sequence formula. 1A. Helical wheel depiction of the 18 residue α-core sequence formula. 1B. Schematic representing linear formula. Hydrophobic residues (F, W, Y, V, I, L, M, C, A, G) are in various shades of green, with greater hydrophobicity indicated by increasingly darker hues. Hydrophilic residues (K, R, H, E, D, N, Q, S, T, A, G) are represented by: blue—cationic; red—anionic; orange—uncharged polar. Alanine (light green) and glycine (yellow) are included with both hydrophilic and hydrophobic groups. H—hydrophobic; P—polar.

FIG. 2 shows the alignment of prototypic AHAPs with α-core sequence formula. 18 initiation points (SEQ ID NO:6867-6884) for the scanning iterative α-core formula are shown, representing the process by which the ProSite pattern search tool was utilized to query the SwissProt database. Coloration is as per FIG. 1A-1B.

DETAILED DESCRIPTION

Figure 1A:
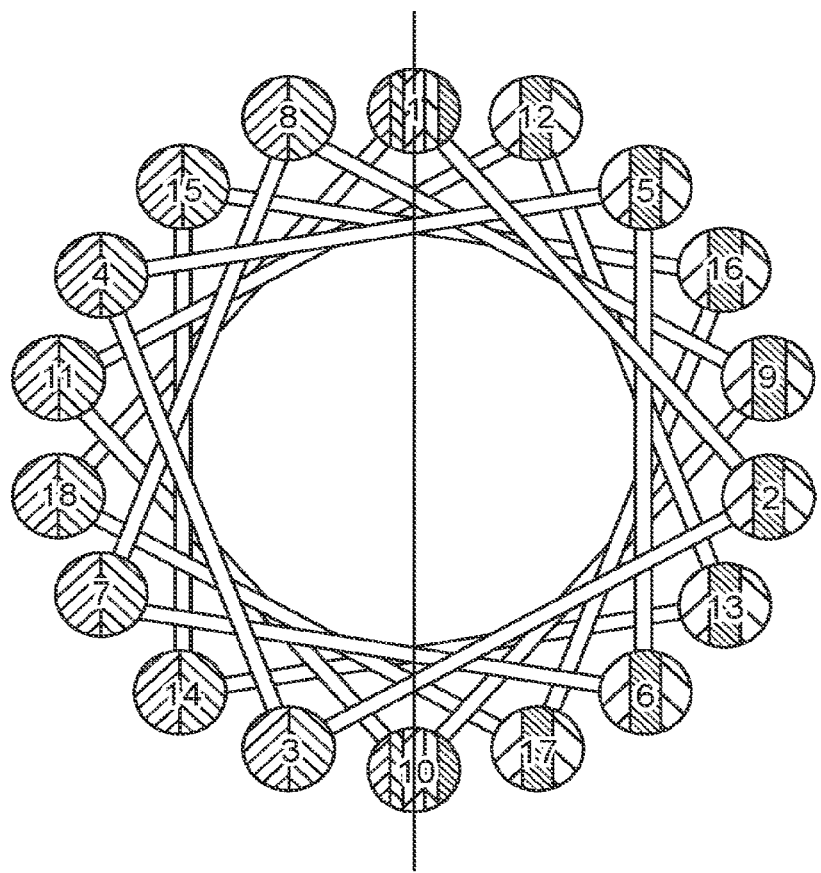

It is to be understood that this disclosure is not limited to particular embodiments described, as such may, of course, vary. It is also to be understood that the terminology used herein is for the purpose of describing particular embodiments only, and is not intended to be limiting, since the scope of the present disclosure will be limited only by the appended claims.

It must be noted that as used herein and in the appended claims, the singular forms "a", "an", and "the" include plural referents unless the context clearly dictates otherwise. Thus, for example, reference to "a peptide" includes a plurality of peptides.

1. Definitions

Unless defined otherwise, all technical and scientific terms used herein have the same meaning as commonly understood by one of ordinary skill in the art to which this disclosure belongs. As used herein the following terms have the following meanings.

As used herein, the term "comprising" or "comprises" is intended to mean that the compositions and methods include the recited elements, but not excluding others. "Consisting essentially of" when used to define compositions and methods, shall mean excluding other elements of any essential significance to the combination for the stated purpose. Thus, a composition consisting essentially of the elements as defined herein would not exclude other materials or steps that do not materially affect the basic and novel characteristic(s) claimed. "Consisting of" shall mean excluding more than trace elements of other ingredients and substantial method steps. Embodiments defined by each of these transition terms are within the scope of this disclosure.

The term "about" when used before a numerical designation, e.g., temperature, time, amount, and concentration, including range, indicates approximations which may vary by (+) or (−) 10%, 5% or 1%.

As used herein, the term "sequence identity" refers to a level of amino acid residue or nucleotide identity between two peptides or between two nucleic acid molecules. When a position in the compared sequence is occupied by the same base or amino acid, then the molecules are identical at that position. A peptide (or a polypeptide or peptide region) has a certain percentage (for example, at least about 60%, or at least about 65%, or at least about 70%, or at least about 75%, or at least about 80%, or at least about 83%, or at least about 85%, or at least about 90%, or at least about 95%, or at least about 98% or at least about 99%) of "sequence identity" to another sequence means that, when aligned, that percentage of bases (or amino acids) are the same in comparing the two sequences. It is noted that, for any sequence ("reference sequence") disclosed in this application, sequences having at least about 60%, or at least about 65%, or at least about 70%, or at least about 75%, or at least about 80%, or at least about 83%, or at least about 85%, or at least about 90%, or at least about 95%, or at least about 98% or at least about 99% sequence identity to the reference sequence are also within the disclosure.

Likewise, the present disclosure also includes sequences that have one, two, three, four, or five substitution, deletion or addition of amino acid residues or nucleotides as compared to the reference sequences.

In any of the embodiments described herein, analogs of a peptide comprising any amino acid sequence described herein are also provided, which have at least about 80%, or at least about 83%, or at least about 85%, or at least about 90%, or at least about 95%, or at least about 98%, or at least about 99% sequence identity to any of reference amino acid sequences. In some embodiments, the analogs include one, two, three, four, or five substitution, deletion or addition of amino acid residues as compared to the reference sequences. In some embodiments, the substitution is a conservative substitution.

As used herein the term "amino acid" refers to either natural and/or unnatural or synthetic amino acids, including glycine and both the D and L optical isomers, amino acid analogs and peptidomimetics. In some embodiments, non-natural amino acids are useful for tuning or engineering the helix or other secondary or tertiary structures of a peptide or protein for desired antimicrobial properties.

As is well-known in the art, a "conservative substitution" of an amino acid or a "conservative substitution variant" of a peptide refers to an amino acid substitution which maintains: 1) the secondary structure of the peptide; 2) the charge or hydrophobicity of the amino acid; and 3) the bulkiness of the side chain or any one or more of these characteristics. Illustratively, the well-known terminologies "hydrophilic residues" relate to serine or threonine. "Hydrophobic residues" refer to leucine, isoleucine, phenylalanine, valine or alanine, or the like. "Positively charged residues" relate to lysine, arginine, ornithine, or histidine. "Negatively charged residues" refer to aspartic acid or glutamic acid. Residues having "bulky side chains" refer to phenylalanine, tryptophan or tyrosine, or the like. A list of illustrative conservative amino acid substitutions is given in Table A.

TABLE A

| For Amino Acid | Replace With |
| --- | --- |
| Alanine | D-Ala, Gly, Aib, β-Ala, L-Cys, D-Cys |
| Arginine | D-Arg, Lys, D-Lys, Orn D-Orn |
| Asparagine | D-Asn, Asp, D-Asp, Glu, D-Glu Gln, D-Gln |
| Aspartic Acid | D-Asp, D-Asn, Asn, Glu, D-Glu, Gln, D-Gln |
| Cysteine | D-Cys, S-Me-Cys, Met, D-Met, Thr, D-Thr, L-Ser, D-Ser |
| Glutamine | D-Gln, Asn, D-Asn, Glu, D-Glu, Asp, D-Asp |
| Glutamic Acid | D-Glu, D-Asp, Asp, Asn, D-Asn, Gln, D-Gln |
| Glycine | Ala, D-Ala, Pro, D-Pro, Aib, β-Ala |
| Isoleucine | D-Ile, Val, D-Val, Leu, D-Leu, Met, D-Met |
| Leucine | Val, D-Val, Met, D-Met, D-Ile, D-Leu, Ile |
| Lysine | D-Lys, Arg, D-Arg, Orn, D-Orn |
| Methionine | D-Met, S-Me-Cys, Ile, D-Ile, Leu, D-Leu, Val, D-Val |
| Phenylalanine | D-Phe, Tyr, D-Tyr, His, D-His, Trp, D-Trp |
| Proline | D-Pro |
| Serine | D-Ser, Thr, D-Thr, allo-Thr, L-Cys, D-Cys |
| Threonine | D-Thr, Ser, D-Ser, allo-Thr, Met, D-Met, Val, D-Val |
| Tyrosine | D-Tyr, Phe, D-Phe, His, D-His, Trp, D-Trp |
| Valine | D-Val, Leu, D-Leu, Ile, D-Ile, Met, D-Met |

Alternatively, non-limiting examples of conservative amino acid substitutions are provided in Table B below, where a similarity score of 0 or higher indicates conservative substitution between the two amino acids.

TABLE B

|   | C | G | P | S | A | T | D | E | N | Q | H | K | R | V | M | I | L | F | Y | W |
| --- | --- | --- | --- | --- | --- | --- | --- | --- | --- | --- | --- | --- | --- | --- | --- | --- | --- | --- | --- | --- |
| W | −8 | −7 | −6 | −2 | −6 | −5 | −7 | −7 | −4 | −5 | −3 | −3 | 2 | −6 | −4 | −5 | −2 | 0 | 0 | 17 |
| Y | 0 | −5 | −5 | −3 | −3 | −3 | −4 | −4 | −2 | −4 | 0 | −4 | −5 | −2 | −2 | −1 | −1 | 7 | 10 |   |
| F | −4 | −5 | −5 | −3 | −4 | −3 | −6 | −5 | −4 | −5 | −2 | −5 | −4 | −1 | 0 | 1 | 2 | 9 |   |   |
| L | −6 | −4 | −3 | −3 | −2 | −2 | −4 | −3 | −3 | −2 | −2 | −3 | −3 | 2 | 4 | 2 | 6 |   |   |   |
| I | −2 | −3 | −2 | −1 | −1 | 0 | −2 | −2 | −2 | −2 | −2 | −2 | −2 | 4 | 2 | 5 |   |   |   |   |
| M | −5 | −3 | −2 | −2 | −1 | −1 | −3 | −2 | 0 | −1 | −2 | 0 | 0 | 2 | 6 |   |   |   |   |   |
| V | −2 | −1 | −1 | −1 | 0 | 0 | −2 | −2 | −2 | −2 | −2 | −2 | −2 | 4 |   |   |   |   |   |   |
| R | −4 | −3 | 0 | 0 | −2 | −1 | −1 | −1 | 0 | 1 | 2 | 3 | 6 |   |   |   |   |   |   |   |
| K | −5 | −2 | −1 | 0 | −1 | 0 | 0 | 0 | 1 | 1 | 0 | 5 |   |   |   |   |   |   |   |   |
| H | −3 | −2 | 0 | −1 | −1 | −1 | 1 | 1 | 2 | 3 | 6 |   |   |   |   |   |   |   |   |   |
| Q | −5 | −1 | 0 | −1 | 0 | −1 | 2 | 2 | 1 | 4 |   |   |   |   |   |   |   |   |   |   |
| N | −4 | 0 | −1 | 1 | 0 | 0 | 2 | 1 | 2 |   |   |   |   |   |   |   |   |   |   |   |
| E | −5 | 0 | −1 | 0 | 0 | 0 | 3 | 4 |   |   |   |   |   |   |   |   |   |   |   |   |
| D | −5 | 1 | −1 | 0 | 0 | 0 | 4 |   |   |   |   |   |   |   |   |   |   |   |   |   |
| T | −2 | 0 | 0 | 1 | 1 | 3 |   |   |   |   |   |   |   |   |   |   |   |   |   |   |

TABLE B-continued

| | C | G | P | S | A | T | D | E | N | Q | H | K | R | V | M | I | L | F | Y | W |
|---|---|---|---|---|---|---|---|---|---|---|---|---|---|---|---|---|---|---|---|---|
| A | -2 | 1 | 1 | 1 | 2 | | | | | | | | | | | | | | | |
| S | 0 | 1 | 1 | 1 | | | | | | | | | | | | | | | | |
| P | -3 | -1 | 6 | | | | | | | | | | | | | | | | | |
| G | -3 | 5 | | | | | | | | | | | | | | | | | | |
| C | 12 | | | | | | | | | | | | | | | | | | | |

Alternatively, non-limiting examples of conservative amino acid substitutions include substitutions of a polar amino acid with a different polar amino acid, or substitutions of a hydrophobic amino acid with a different hydrophobic amino acid, as illustrated in Table C below. Each of the polar amino acids or hydrophobic amino acids, in some embodiments, can be substituted with Ala or Gly.

TABLE C

| Polar amino acids | K, R, H, E, D, N, Q, S, T (or substituted with A or G) |
|---|---|
| Hydrophobic amino acids | V, I, L, M, C, F, W, Y (or substituted with A or G) |

As used herein, the term "composition" refers to a preparation suitable for administration to an intended patient for therapeutic purposes that contains at least one pharmaceutically active ingredient, including any solid form thereof. The composition may include at least one pharmaceutically acceptable component to provide an improved formulation of the compound, such as a suitable carrier. In certain embodiments, the composition is formulated as a film, gel, patch, or liquid solution.

As used herein, the term "pharmaceutically acceptable" indicates that the indicated material does not have properties that would cause a reasonably prudent medical practitioner to avoid administration of the material to a patient, taking into consideration the disease or conditions to be treated and the respective route of administration. For example, it is commonly required that such a material be essentially sterile.

2. Antimicrobial α-Helical Antimicrobial Peptides

The present disclosure, in some embodiments, describes a computational approach for generating a systemic formula from known α-helical antimicrobial peptides and using the formula to screen for new α-helical antimicrobial peptides. The systematic formula integrates features of idealized amphipathic and/or antimicrobial helices spanning up to 18 positions of canonical right-handed α-helices. Results demonstrate that nearly all families of known antimicrobial α-helical peptides align with the formula. In addition, many previously uncharacterized sequences were predicted to have direct antimicrobial activity. Synthesis of selected candidates and in vitro efficacy against human pathogens affirmed the veracity of model predictions and established validity of the α-core formula and search strategy. As a result, novel protein and peptide families and their specific sequences are identified as having potent and direct microbicidal efficacy that heretofore had not been ascribed.

The identified protein and peptide families and their specific sequences are provided in Tables 2-4 and SEQ ID NO:518-6860. In some embodiments, provided is an isolated peptide comprising an amino acid sequence of Table 2, 3 or 4 or any one of SEQ ID NO:518-6860, or an amino acid derived therefrom with one, two or three amino acid substitution. In some embodiments, the substitution is a conservative substitution. In some embodiments, the substitution is the replacement of a polar amino acid with a different polar amino acid (or A or G), or the replacement of a hydrophobic amino acid with a different hydrophobic amino acid (or A or G).

In some embodiments, provided is an isolated peptide comprising an amino acid sequence selected from the group consisting of SEQ ID NO: 1-14 and an amino acid derived from anyone of SEQ ID NO: 1-14 with one, two or three amino acid substitution. In some embodiments, the substitution is a conservative substitution. In some embodiments, the substitution is the replacement of a polar amino acid with a different polar amino acid (or A or G), or the replacement of a hydrophobic amino acid with a different hydrophobic amino acid (or A or G). In some embodiments, the peptide comprises the amino acid sequence of anyone of SEQ ID NO: 1-14.

In some embodiments, the peptide is a fragment or fusion peptide described from natural proteins. In some embodiments, the peptide differs from natural proteins by at least an amino acid substation, addition or deletion.

In some embodiments, the peptide is not longer than 100 amino acid residues in length. In some embodiments, the peptide is not longer than 95, 90, 85, 80, 75, 70, 65, 60, 55, 50, 45, 40, 35, 30 or 25 amino acid resides in length. In some embodiments, the peptide has antimicrobial activity.

Fusion peptides are also described. In one embodiment, the present disclosure provides a fusion peptide comprising a first fragment selected from the sequences of Table 2, 3 or 4 or any one of SEQ ID NO:518-6860 or an amino acid derived from a sequence of Table 2, or 3 or any one of SEQ ID NO:518-6860 with one, or two or three amino acid substitution, and a second fragment having antimicrobial activity. In some embodiments, the second fragment comprises a gamma-core motif comprising two anti-parallel β-sheets interposed by a short turn region with a GXC or CXG sequence pattern integrated into one of the β-sheets.

As used herein, the terms "gamma-core motif," or "γ-core," and equivalents thereof refer to a multidimensional protein signature, in particular a multidimensional antimicrobial signature, that is characterized by two anti-parallel β-sheets interposed by a short turn region with a conserved GXC (dextromeric) or CXG (levomeric) sequence pattern integrated into one β-sheet. Additional features that characterize the γ-core motif include a hydrophobic bias toward the C-terminal aspect and cationic charge positioned at the inflection point and termini of the β-sheet domains, polarizing charge along the longitudinal axis of the γ-core.

The kinocidin γ-core ($γ_{KC}$ core) signature is an iteration of the antimicrobial peptide γ-core ($γ_{AP}$), conforming to an anti-parallel β-hairpin comprised of a 13-17 amino acid pattern with a central hydrophobic region typically flanked by basic residues. The $γ_{KC}$ core motif can be characterized by the following consensus sequence formula:

$$\text{NH}_2 \text{ [C]-[X}_{10\text{-}13}\text{]-[GX}_{2\text{-}3}\text{C]-[X}_2\text{]-[P] COOH} \quad \text{(SEQ ID NO: 6862)}$$

Human IL-8, which contains the kinocidin γ-core ($\gamma_{KC}$ core) signature, has the sequence:

$$\text{NH}_2 \text{ CANTEIIVKLSDGRELCLDP COOH} \quad \text{(SEQ ID NO: 6863)}$$

This fragment of the IL-8 sequence is consistent with the consensus $\gamma_{KC}$-core motif. Furthermore, many kinocidins exhibit a recurring amino acid position pattern, consistent with the consensus $\gamma_{KC}$ core formula:

$$\text{NH}_2 \text{ CX}_4\text{Z}_3\text{X}_{0\text{-}2}[\text{K}^{81}]\text{X}_{1\text{-}3}\text{G}][\text{K}^{72}][\text{B}^{86}][\text{Z}^{92}]\text{C}[\text{Z}^{86}][\text{D}^{86}][\text{P}^{95}] \text{ COOH}$$
$$\phantom{\text{NH}_2 \text{ CX}_4\text{Z}_3\text{X}_{0\text{-}2}[\text{K}^{81}]\text{X}_{1\text{-}3}\text{G}][\text{K}^{72}]}\text{R}\phantom{][\text{Z}^{92}]\text{C}[\text{Z}^{86}]}\text{N}$$

where Z represents the hydrophobic residues A, F, I, L, V, W, Y; B represents the charged or polar residues D, E, H, K, N, R, Q; C, P, or G correspond to cysteine, proline, or glycine, respectively, X indicates variable amino acid position; and numeric superscripts of bracketed positions indicate relative frequency in percent, with common alternate residues listed beneath.

In one embodiment, the gamma-core motif comprises CPTAQLIATLKNGRKICLDLQ (SEQ ID NO: 15) or a first amino acid sequence having at least 85% sequence identity to SEQ ID NO: 15. In one aspect, variants of the γ-core can include CPTAQLIATLKNGRKICLDLQP (SEQ ID NO: 16), CPTAQLIATLKNGRKICLDLQAP (SEQ ID NO: 17) and CPTAQLIATLKNGRKICLDLQA (SEQ ID NO: 18).

A linker can optionally be included between the first fragment and the second fragment, which is preferably 10 amino acids or fewer in length. In some aspect, the spacer is 9, 8, 6, 5, 4, 3, 2 amino acids in length or shorter. The spacer can include any amino acids, such as Ala, Pro, Cys, and Gly.

In some embodiments, the fusion peptide has antimicrobial activity. In some embodiments, the peptides may be conjugated to therapeutic agents, prodrugs, peptides, proteins, enzymes, viruses, lipids, biological response modifiers, pharmaceutical agents, or PEG.

The peptides may be conjugated or fused to a therapeutic agent, which may include detectable labels such as radioactive labels, an immunomodulator, a hormone, an enzyme, an oligonucleotide, a photoactive therapeutic or diagnostic agent, a cytotoxic agent, which may be a drug or a toxin, an ultrasound enhancing agent, a non-radioactive label, a combination thereof and other such agents known in the art. The peptides can be detectably labeled by coupling it to a chemiluminescent compound. The presence of the chemiluminescent-tagged antigen-binding polypeptide is then determined by detecting the presence of luminescence that arises during the course of a chemical reaction. Examples of particularly useful chemiluminescent labeling compounds are luminol, isoluminol, theromatic acridinium ester, imidazole, acridinium salt and oxalate ester.

3. Synthesis of Antimicrobial Peptides

The peptides described herein can be ordered from a commercial source or partially or fully synthesized using methods well known in the art (e.g., chemical and/or biotechnological methods). In certain embodiments, the peptides are synthesized according to solid phase peptide synthesis protocols that are well known in the art. In another embodiment, the peptide is synthesized on a solid support according to the well-known Fmoc protocol, cleaved from the support with trifluoroacetic acid and purified by chromatography according to methods known to persons skilled in the art. In other embodiments, the peptide is synthesized utilizing the methods of biotechnology that are well known to persons skilled in the art. In one embodiment, a DNA sequence that encodes the amino acid sequence information for the desired peptide is ligated by recombinant DNA techniques known to persons skilled in the art into an expression plasmid (for example, a plasmid that incorporates an affinity tag for affinity purification of the peptide), the plasmid is transfected into a host organism for expression, and the peptide is then isolated from the host organism or the growth medium, e.g., by affinity purification.

(SEQ ID NO: 6864)

(SEQ ID NO: 6865)

The peptides can be also prepared by using recombinant expression systems. Generally, this involves inserting the nucleic acid molecule into an expression system to which the molecule is heterologous (i.e., not normally present). One or more desired nucleic acid molecules encoding a peptide of the disclosure may be inserted into the vector. When multiple nucleic acid molecules are inserted, the multiple nucleic acid molecules may encode the same or different peptides. The heterologous nucleic acid molecule is inserted into the expression system or vector in proper sense (5'→3') orientation relative to the promoter and any other 5' regulatory molecules, and correct reading frame.

Purified peptides may be obtained by several methods. The peptide is preferably produced in purified form (preferably at least about 80% or 85% pure, more preferably at least about 90% or 95% pure) by conventional techniques. Depending on whether the recombinant host cell is made to secrete the peptide into growth medium (see U.S. Pat. No. 6,596,509 to Bauer et al., which is hereby incorporated by reference in its entirety), the peptide can be isolated and purified by centrifugation (to separate cellular components from supernatant containing the secreted peptide) followed by sequential ammonium sulfate precipitation of the supernatant. The fraction containing the peptide is subjected to gel filtration in an appropriately sized dextran or polyacrylamide column to separate the peptides from other proteins. If necessary, the peptide fraction may be further purified by HPLC.

4. Antimicrobial Compositions and Formulations

Compositions and formulations that include any one or more of the peptides as disclosed herein are also provided. In one embodiment, the composition includes any one or more of the peptides and a pharmaceutically acceptable carrier.

"Pharmaceutically acceptable carriers" refers to any diluents, excipients, or carriers that may be used in the compositions of the disclosure. Pharmaceutically acceptable carriers include ion exchangers, alumina, aluminum stearate, lecithin, serum proteins, such as human serum albumin, buffer substances, such as phosphates, glycine, sorbic acid, potassium sorbate, partial glyceride mixtures of saturated vegetable fatty acids, water, salts or electrolytes, such as protamine sulfate, disodium hydrogen phosphate, potassium hydrogen phosphate, sodium chloride, zinc salts, colloidal silica, magnesium trisilicate, polyvinyl pyrrolidone, cellulose-based substances, polyethylene glycol, sodium carboxymethylcellulose, polyacrylates, waxes, polyethylenepolyoxypropylene-block polymers, polyethylene glycol and wool fat. Suitable pharmaceutical carriers are described in *Remington's Pharmaceutical Sciences*, Mack Publishing Company, a standard reference text in this field. They are preferably selected with respect to the intended form of administration, that is, oral tablets, capsules, elixirs, syrups and the like, and consistent with conventional pharmaceutical practices.

The pharmaceutical compositions of the disclosure can be manufactured by methods well known in the art such as conventional granulating, mixing, dissolving, encapsulating, lyophilizing, or emulsifying processes, among others. Compositions may be produced in various forms, including granules, precipitates, or particulates, powders, including freeze dried, rotary dried or spray dried powders, amorphous powders, injections, emulsions, elixirs, suspensions or solutions. Formulations may optionally contain stabilizers, pH modifiers, surfactants, bioavailability modifiers and combinations of these.

Pharmaceutical formulations may be prepared as liquid suspensions or solutions using a sterile liquid, such as oil, water, alcohol, and combinations thereof. Pharmaceutically suitable surfactants, suspending agents or emulsifying agents, may be added for oral or parenteral administration. Suspensions may include oils, such as peanut oil, sesame oil, cottonseed oil, corn oil and olive oil. Suspension preparation may also contain esters of fatty acids, such as ethyl oleate, isopropyl myristate, fatty acid glycerides and acetylated fatty acid glycerides. Suspension formulations may include alcohols, such as ethanol, isopropyl alcohol, hexadecyl alcohol, glycerol and propylene glycol. Ethers, such as poly(ethyleneglycol), petroleum hydrocarbons, such as mineral oil and petrolatum, and water may also be used in suspension formulations.

The compositions of this disclosure are formulated for pharmaceutical administration to a mammal, preferably a human being. Such pharmaceutical compositions of the disclosure may be administered in a variety of ways, preferably parenterally.

Sterile injectable forms of the compositions of this disclosure may be aqueous or oleaginous suspension. These suspensions may be formulated according to techniques known in the art using suitable dispersing or wetting agents and suspending agents. The sterile injectable preparation may also be a sterile injectable solution or suspension in a non-toxic parenterally acceptable diluent or solvent, for example as a solution in 1,3-butanediol. Among the acceptable vehicles and solvents that may be employed are water, Ringer's solution and isotonic sodium chloride solution. In addition, sterile, fixed oils are conventionally employed as a solvent or suspending medium. For this purpose, any bland fixed oil may be employed including synthetic mono- or di-glycerides. Fatty acids, such as oleic acid and its glyceride derivatives are useful in the preparation of injectables, as are natural pharmaceutically-acceptable oils, such as olive oil or castor oil, especially in their polyoxyethylated versions. These oil solutions or suspensions may also contain a long-chain alcohol diluent or dispersant, such as carboxymethyl cellulose or similar dispersing agents which are commonly used in the formulation of pharmaceutically acceptable dosage forms including emulsions and suspensions. Other commonly used surfactants, such as Tweens, Spans and other emulsifying agents or bioavailability enhancers which are commonly used in the manufacture of pharmaceutically acceptable solid, liquid, or other dosage forms may also be used for the purposes of formulation. Compounds may be formulated for parenteral administration by injection such as by bolus injection or continuous infusion. A unit dosage form for injection may be in ampoules or in multi-dose containers.

In addition to dosage forms described above, pharmaceutically acceptable excipients and carriers and dosage forms are generally known to those skilled in the art and are included in the disclosure. It should be understood that a specific dosage and treatment regimen for any particular patient will depend upon a variety of factors, including the activity of the specific peptide employed, the age, body weight, general health, sex and diet, renal and hepatic function of the patient, and the time of administration, rate of excretion, drug combination, judgment of the treating physician or veterinarian and severity of the particular disease being treated.

In some embodiments, the composition can further include a secondary antimicrobial agent. Non-limiting examples of such agents include imipenem, ceftazidime, colistin, chloroquine, artemisinin, vancomycin and daptomycin.

5. Therapeutic Methods

Methods of using the peptides, compositions and formulations of the present disclosure are also described. In one embodiment, the methods are for preventing or treating an infection of a microorganism. The microorganism can be a bacterium, such as a Gram-negative bacterium or a Gram-positive bacterium, a fungus, or a parasite.

The peptides, compositions and formulations are also useful for treating a disease or condition associated with an infection, such as wound abscess, catheter biofilm, pneumonia, and bacteremia.

In some embodiments, the treatment methods further include administration, concurrently or sequentially, of a second secondary antimicrobial agent. Non-limiting examples of such agents include imipenem, ceftazidime, colistin, chloroquine, artemisinin, vancomycin and daptomycin.

The peptides, compositions and formulations of the disclosure may be administered to the systemic circulation via parental administration. The term "parenteral" as used herein includes subcutaneous, intravenous, intramuscular, intra-articular, intra-synovial, intrasternal, intrathecal, intrahepatic, intralesional and intracranial injection or infusion techniques. However, in cases where the infection is local (e.g., on the skin), the composition may be administered locally, such as topically.

6. Computational System and Methods

Figure 10:
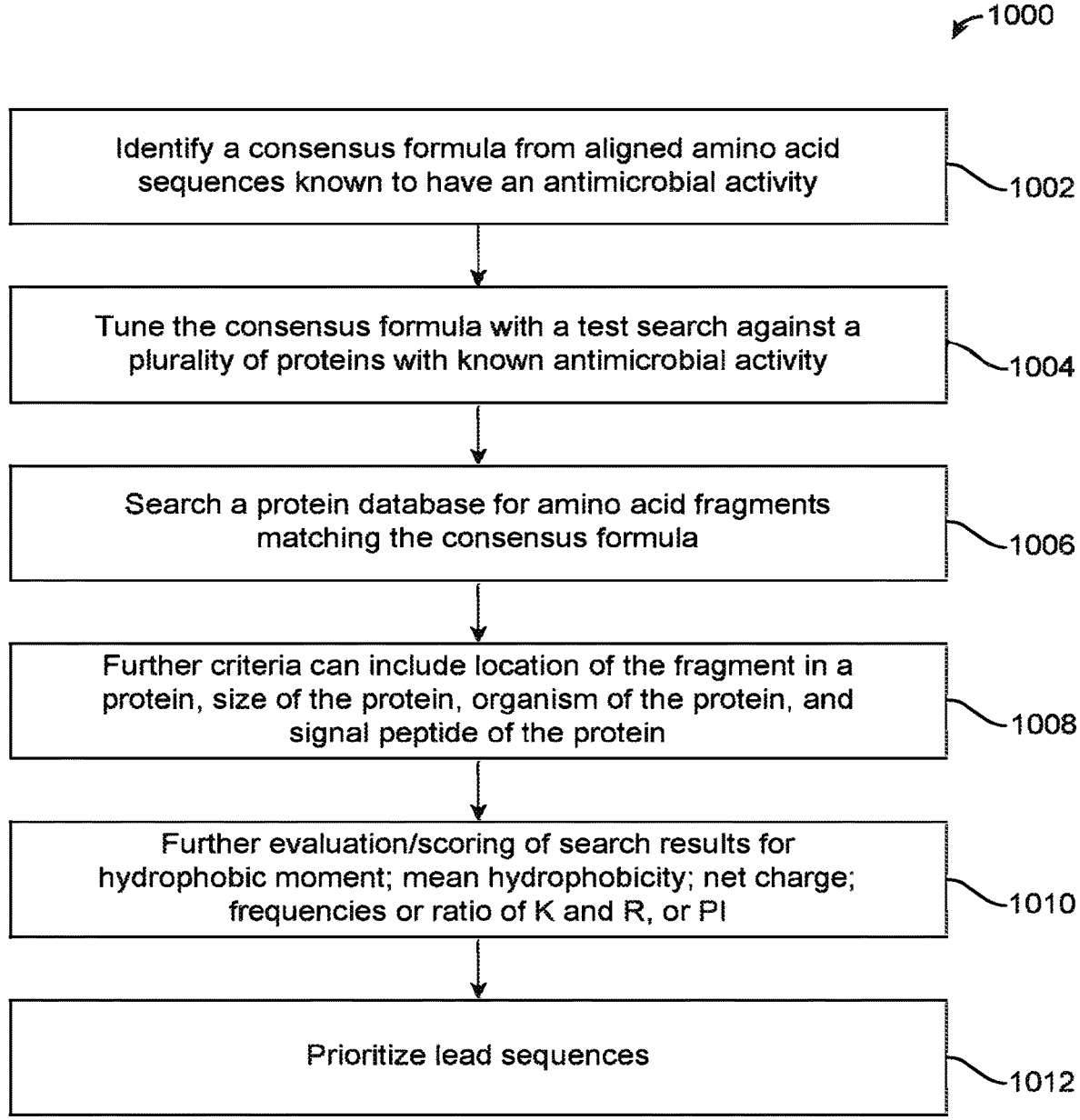
FIG. 10 illustrates an example process flow chart of a method, according to some implementations.

The present disclosure, in some embodiments, provides computer-implemented methods for identifying antimicrobial sequences and related systems and non-transitory computer-readable media. In one embodiment, a computer-implemented method of identifying a peptide having antimicrobial activity is provided, as illustrated in FIG. 10 which is a process flow chart of a method 1000. The various processing operations and/or data flows depicted in FIG. 10 (and in the other drawing figures) are described in greater detail herein. The described operations may be accomplished using some or all of the system components described in detail above and, in some implementations, various operations may be performed in different sequences and various operations may be omitted. Additional operations may be performed along with some or all of the operations shown in the depicted flow diagrams. One or more operations may be performed simultaneously. Accordingly, the operations as illustrated (and described in greater detail below) are exemplary by nature and, as such, should not be viewed as limiting.

At step 1002, pursuant to a user command, the system, such as personal computing device, identifies a consensus formula from aligned amino acid sequences known to have an antimicrobial activity, such as those known as α-helical antimicrobial peptides. An example formula is X-[VILMCFWYAG]-[KRHEDNQSTAG]-[KRHEDNQSTAG]-[VILMCFWYAG]-[VILMCFWYAG]-[KRHEDNQSTAG]-[KRHEDNQSTAG]-[VILMCFWYAG]-X-[KRHEDNQSTAG]-[VILMCFWYAG] (SEQ ID NO:6861), wherein X denotes any amino acid residue. The formula can be tested with a dataset that include known antimicrobial peptides and the formula can be further tuned (step 1004). For instance, the formula may be shortened or lengthened, or certain amino acid residues can include more or fewer substitutions.

The formula can then be used to search in a protein database (step 1006) for sequences or fragment that match the requirement of the formula. In some embodiments, the search query include one or more criteria such as location of the fragment in a protein, size of the protein, and organism of the protein (step 1008). In particular, in one embodiment, the search results are further evaluated for the presence of a signal peptide in the corresponding protein.

In some embodiments, the search results are further evaluated with respect to their biological, chemical, physical or sequential properties. Example properties include, without limitation, hydrophobic moment; mean hydrophobicity; net charge; frequencies or ratio of K and R; and isoelectric point (PI). Each of these evaluation scores can be used for prioritizing, ranking, filtering the search results (step 1012). Optionally, some of the search results are synthesized and tested in the lab for their antimicrobial activities.

Figure 11:
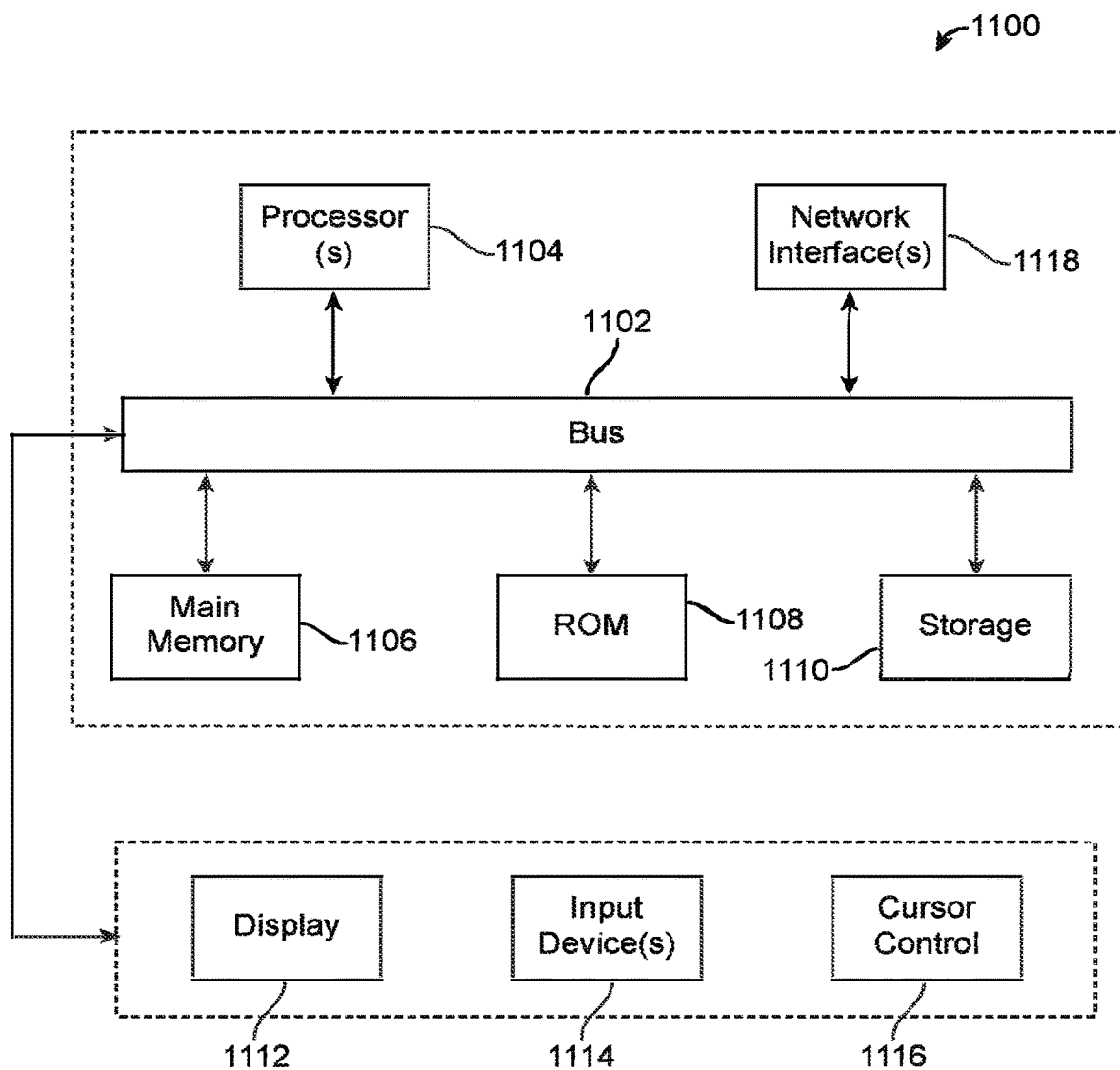
FIG. 11 illustrates a block diagram of an example computer system in which any of the implementations described herein may be implemented.

FIG. 11 depicts a block diagram of an example computer system 1100 in which any of the embodiments described herein may be implemented. The computer system 1100 includes a bus 1102 or other communication mechanism for communicating information, one or more hardware processors 1104 coupled with bus 1102 for processing information. Hardware processor(s) 1104 may be, for example, one or more general purpose microprocessors.

The computer system 1100 also includes a main memory 1106, such as a random access memory (RAM), cache and/or other dynamic storage devices, coupled to bus 1102 for storing information and instructions to be executed by processor 1104. Main memory 1106 also may be used for storing temporary variables or other intermediate information during execution of instructions to be executed by processor 1104. Such instructions, when stored in storage media accessible to processor 1104, render computer system 1100 into a special-purpose machine that is customized to perform the operations specified in the instructions.

The computer system 1100 further includes a read only memory (ROM) 1108 or other static storage device coupled to bus 1102 for storing static information and instructions for processor 1104. A storage device 1110, such as a magnetic disk, optical disk, or USB thumb drive (Flash drive), etc., is provided and coupled to bus 1102 for storing information and instructions.

The computer system 1100 may be coupled via bus 1102 to a display 1112, such as a cathode ray tube (CRT) or LCD display (or touch screen), for displaying information to a computer user. An input device 1114, including alphanumeric and other keys, is coupled to bus 1102 for communicating information and command selections to processor 1104. Another type of user input device is cursor control 1116, such as a mouse, a trackball, or cursor direction keys for communicating direction information and command selections to processor 1104 and for controlling cursor movement on display 1112. This input device typically has two degrees of freedom in two axes, a first axis (e.g., x) and a second axis (e.g., y), that allows the device to specify positions in a plane. In some embodiments, the same direction information and command selections as cursor control may be implemented via receiving touches on a touch screen without a cursor.

The computing system 1100 may include a user interface module to implement a GUI that may be stored in a mass storage device as executable software codes that are executed by the computing device(s). This and other modules may include, by way of example, components, such as software components, object-oriented software components, class components and task components, processes, functions, attributes, procedures, subroutines, segments of program code, drivers, firmware, microcode, circuitry, data, databases, data structures, tables, arrays, and variables.

In general, the word "module," as used herein, refers to logic embodied in hardware or firmware, or to a collection of software instructions, possibly having entry and exit points, written in a programming language, such as, for example, Java, C or C++. A software module may be compiled and linked into an executable program, installed in a dynamic link library, or may be written in an interpreted programming language such as, for example, BASIC, Perl, or Python. It will be appreciated that software modules may be callable from other modules or from themselves, and/or may be invoked in response to detected events or interrupts. Software modules configured for execution on computing devices may be provided on a computer readable medium, such as a compact disc, digital video disc, flash drive, magnetic disc, or any other tangible medium, or as a digital download (and may be originally stored in a compressed or installable format that requires installation, decompression or decryption prior to execution). Such software code may be stored, partially or fully, on a memory device of the executing computing device, for execution by the computing device. Software instructions may be embedded in firmware, such as an EPROM. It will be further appreciated that hardware modules may be comprised of connected logic units, such as gates and flip-flops, and/or may be comprised of programmable units, such as programmable gate arrays or processors. The modules or computing device functionality described herein are preferably implemented as software modules, but may be represented in hardware or firmware. Generally, the modules described herein refer to logical modules that may be combined with other modules or divided into sub-modules despite their physical organization or storage.

The computer system 1100 may implement the techniques described herein using customized hard-wired logic, one or more ASICs or FPGAs, firmware and/or program logic which in combination with the computer system causes or programs computer system 1100 to be a special-purpose machine. According to one embodiment, the techniques herein are performed by computer system 1100 in response to processor(s) 1104 executing one or more sequences of one or more instructions contained in main memory 1106. Such instructions may be read into main memory 1106 from another storage medium, such as storage device 1110. Execution of the sequences of instructions contained in main memory 1106 causes processor(s) 1104 to perform the process steps described herein. In alternative embodiments, hard-wired circuitry may be used in place of or in combination with software instructions.

The term "non-transitory media," and similar terms, as used herein refers to any media that store data and/or instructions that cause a machine to operate in a specific fashion. Such non-transitory media may comprise non-volatile media and/or volatile media. Non-volatile media includes, for example, optical or magnetic disks, such as storage device 1110. Volatile media includes dynamic memory, such as main memory 1106. Common forms of non-transitory media include, for example, a floppy disk, a flexible disk, hard disk, solid state drive, magnetic tape, or any other magnetic data storage medium, a CD-ROM, any other optical data storage medium, any physical medium with patterns of holes, a RAM, a PROM, and EPROM, a FLASH-EPROM, NVRAM, any other memory chip or cartridge, and networked versions of the same.

Non-transitory media is distinct from but may be used in conjunction with transmission media. Transmission media participates in transferring information between non-transitory media. For example, transmission media includes coaxial cables, copper wire and fiber optics, including the wires that comprise bus 1102. Transmission media can also take the form of acoustic or light waves, such as those generated during radio-wave and infra-red data communications.

Various forms of media may be involved in carrying one or more sequences of one or more instructions to processor 1104 for execution. For example, the instructions may initially be carried on a magnetic disk or solid state drive of a remote computer. The remote computer can load the instructions into its dynamic memory and send the instructions over a telephone line using a modem. A modem local to computer system 1100 can receive the data on the telephone line and use an infra-red transmitter to convert the data to an infra-red signal. An infra-red detector can receive the data carried in the infra-red signal and appropriate circuitry can place the data on bus 1102. Bus 1102 carries the data to main memory 1106, from which processor 1104 retrieves and executes the instructions. The instructions received by main memory 1106 may retrieves and executes the instructions. The instructions received by main memory 1106 may optionally be stored on storage device 1110 either before or after execution by processor 1104.

The computer system 1100 also includes a communication interface 1118 coupled to bus 1102. Communication interface 1118 provides a two-way data communication coupling to one or more network links that are connected to one or more local networks. For example, communication interface 1118 may be an integrated services digital network (ISDN) card, cable modem, satellite modem, or a modem to provide a data communication connection to a corresponding type of telephone line. As another example, communication interface 1118 may be a local area network (LAN) card to provide a data communication connection to a compatible LAN (or WAN component to communicated with a WAN). Wireless links may also be implemented. In any such implementation, communication interface 1118 sends and receives electrical, electromagnetic or optical signals that carry digital data streams representing various types of information.

A network link typically provides data communication through one or more networks to other data devices. For example, a network link may provide a connection through local network to a host computer or to data equipment operated by an Internet Service Provider (ISP). The ISP in turn provides data communication services through the world wide packet data communication network now commonly referred to as the "Internet". Local network and Internet both use electrical, electromagnetic or optical signals that carry digital data streams. The signals through the various networks and the signals on network link and through communication interface 1118, which carry the digital data to and from computer system 1100, are example forms of transmission media.

The computer system 1100 can send messages and receive data, including program code, through the network(s), network link and communication interface 1118. In the Internet example, a server might transmit a requested code for an application program through the Internet, the ISP, the local network and the communication interface 1118.

The received code may be executed by processor 1104 as it is received, and/or stored in storage device 1110, or other non-volatile storage for later execution.

Each of the processes, methods, and algorithms described in the preceding sections may be embodied in, and fully or partially automated by, code modules executed by one or more computer systems or computer processors comprising computer hardware. The processes and algorithms may be implemented partially or wholly in application-specific circuitry.

The various features and processes described above may be used independently of one another, or may be combined in various ways. All possible combinations and sub-combinations are intended to fall within the scope of this disclosure. In addition, certain method or process blocks may be omitted in some implementations. The methods and processes described herein are also not limited to any particular sequence, and the blocks or states relating thereto can be performed in other sequences that are appropriate. For example, described blocks or states may be performed in an order other than that specifically disclosed, or multiple blocks or states may be combined in a single block or state. The example blocks or states may be performed in serial, in parallel, or in some other manner. Blocks or states may be added to or removed from the disclosed example embodiments. The example systems and components described herein may be configured differently than described. For example, elements may be added to, removed from, or rearranged compared to the disclosed example embodiments.

Conditional language, such as, among others, "can," "could," "might," or "may," unless specifically stated otherwise, or otherwise understood within the context as used, is generally intended to convey that certain embodiments include, while other embodiments do not include, certain features, elements and/or steps. Thus, such conditional language is not generally intended to imply that features, elements and/or steps are in any way required for one or more embodiments or that one or more embodiments necessarily include logic for deciding, with or without user input or prompting, whether these features, elements and/or steps are included or are to be performed in any particular embodiment.

Any process descriptions, elements, or blocks in the flow diagrams described herein and/or depicted in the attached figures should be understood as potentially representing modules, segments, or portions of code which include one or more executable instructions for implementing specific logical functions or steps in the process. Alternate implementations are included within the scope of the embodiments described herein in which elements or functions may be deleted, executed out of order from that shown or discussed, including substantially concurrently or in reverse order, depending on the functionality involved, as would be understood by those skilled in the art.

It should be emphasized that many variations and modifications may be made to the above-described embodiments, the elements of which are to be understood as being among other acceptable examples. All such modifications and variations are intended to be included herein within the scope of this disclosure. The foregoing description details certain embodiments of the invention. It will be appreciated, however, that no matter how detailed the foregoing appears in text, the invention can be practiced in many ways. As is also stated above, it should be noted that the use of particular terminology when describing certain features or aspects of the invention should not be taken to imply that the terminology is being re-defined herein to be restricted to including any specific characteristics of the features or aspects of the invention with which that terminology is associated. The scope of the invention should therefore be construed in accordance with the appended claims and any equivalents thereof.

Engines, Components, and Logic

Certain embodiments are described herein as including logic or a number of components, engines, or mechanisms. Engines may constitute either software engines (e.g., code embodied on a machine-readable medium) or hardware engines. A "hardware engine" is a tangible unit capable of performing certain operations and may be configured or arranged in a certain physical manner. In various example embodiments, one or more computer systems (e.g., a stand-alone computer system, a client computer system, or a server computer system) or one or more hardware engines of a computer system (e.g., a processor or a group of processors) may be configured by software (e.g., an application or application portion) as a hardware engine that operates to perform certain operations as described herein.

In some embodiments, a hardware engine may be implemented mechanically, electronically, or any suitable combination thereof. For example, a hardware engine may include dedicated circuitry or logic that is permanently configured to perform certain operations. For example, a hardware engine may be a special-purpose processor, such as a Field-Programmable Gate Array (FPGA) or an Application Specific Integrated Circuit (ASIC). A hardware engine may also include programmable logic or circuitry that is temporarily configured by software to perform certain operations. For example, a hardware engine may include software executed by a general-purpose processor or other programmable processor. Once configured by such software, hardware engines become specific machines (or specific components of a machine) uniquely tailored to perform the configured functions and are no longer general-purpose processors. It will be appreciated that the decision to implement a hardware engine mechanically, in dedicated and permanently configured circuitry, or in temporarily configured circuitry (e.g., configured by software) may be driven by cost and time considerations.

Accordingly, the phrase "hardware engine" should be understood to encompass a tangible entity, be that an entity that is physically constructed, permanently configured (e.g., hardwired), or temporarily configured (e.g., programmed) to operate in a certain manner or to perform certain operations described herein. As used herein, "hardware-implemented engine" refers to a hardware engine. Considering embodiments in which hardware engines are temporarily configured (e.g., programmed), each of the hardware engines need not be configured or instantiated at any one instance in time. For example, where a hardware engine comprises a general-purpose processor configured by software to become a special-purpose processor, the general-purpose processor may be configured as respectively different special-purpose processors (e.g., comprising different hardware engines) at different times. Software accordingly configures a particular processor or processors, for example, to constitute a particular hardware engine at one instance of time and to constitute a different hardware engine at a different instance of time.

Hardware engines can provide information to, and receive information from, other hardware engines. Accordingly, the described hardware engines may be regarded as being communicatively coupled. Where multiple hardware engines exist contemporaneously, communications may be achieved through signal transmission (e.g., over appropriate circuits and buses) between or among two or more of the hardware engines. In embodiments in which multiple hardware engines are configured or instantiated at different times, communications between such hardware engines may be achieved, for example, through the storage and retrieval of information in memory structures to which the multiple hardware engines have access. For example, one hardware engine may perform an operation and store the output of that operation in a memory device to which it is communicatively coupled. A further hardware engine may then, at a later time, access the memory device to retrieve and process the stored output. Hardware engines may also initiate communications with input or output devices, and can operate on a resource (e.g., a collection of information).

The various operations of example methods described herein may be performed, at least partially, by one or more processors that are temporarily configured (e.g., by software) or permanently configured to perform the relevant operations. Whether temporarily or permanently configured, such processors may constitute processor-implemented engines that operate to perform one or more operations or functions described herein. As used herein, "processor-implemented engine" refers to a hardware engine implemented using one or more processors.

Similarly, the methods described herein may be at least partially processor-implemented, with a particular processor or processors being an example of hardware. For example, at least some of the operations of a method may be performed by one or more processors or processor-implemented engines. Moreover, the one or more processors may also operate to support performance of the relevant operations in a "cloud computing" environment or as a "software as a service" (SaaS). For example, at least some of the operations may be performed by a group of computers (as examples of machines including processors), with these operations being accessible via a network (e.g., the Internet) and via one or more appropriate interfaces (e.g., an Application Program Interface (API)).

The performance of certain of the operations may be distributed among the processors, not only residing within a single machine, but deployed across a number of machines. In some example embodiments, the processors or processor-implemented engines may be located in a single geographic location (e.g., within a home environment, an office environment, or a server farm). In other example embodiments, the processors or processor-implemented engines may be distributed across a number of geographic locations.

Language

Throughout this specification, plural instances may implement components, operations, or structures described as a single instance. Although individual operations of one or more methods are illustrated and described as separate operations, one or more of the individual operations may be performed concurrently, and nothing requires that the operations be performed in the order illustrated. Structures and functionality presented as separate components in example configurations may be implemented as a combined structure or component. Similarly, structures and functionality presented as a single component may be implemented as separate components. These and other variations, modifications, additions, and improvements fall within the scope of the subject matter herein.

Although an overview of the subject matter has been described with reference to specific example embodiments, various modifications and changes may be made to these embodiments without departing from the broader scope of embodiments of the present disclosure. Such embodiments of the subject matter may be referred to herein, individually or collectively, by the term "invention" merely for convenience and without intending to voluntarily limit the scope of this application to any single disclosure or concept if more than one is, in fact, disclosed.

The embodiments illustrated herein are described in sufficient detail to enable those skilled in the art to practice the teachings disclosed. Other embodiments may be used and derived therefrom, such that structural and logical substitutions and changes may be made without departing from the scope of this disclosure. The Detailed Description, therefore, is not to be taken in a limiting sense, and the scope of various embodiments is defined only by the appended claims, along with the full range of equivalents to which such claims are entitled.

It will be appreciated that an "engine," "system," "data store," and/or "database" may comprise software, hardware, firmware, and/or circuitry. In one example, one or more software programs comprising instructions capable of being executable by a processor may perform one or more of the functions of the engines, data stores, databases, or systems described herein. In another example, circuitry may perform the same or similar functions. Alternative embodiments may comprise more, less, or functionally equivalent engines, systems, data stores, or databases, and still be within the scope of present embodiments. For example, the functionality of the various systems, engines, data stores, and/or databases may be combined or divided differently.

"Open source" software is defined herein to be source code that allows distribution as source code as well as compiled form, with a well-publicized and indexed means of obtaining the source, optionally with a license that allows modifications and derived works.

The data stores described herein may be any suitable structure (e.g., an active database, a relational database, a self-referential database, a table, a matrix, an array, a flat file, a documented-oriented storage system, a non-relational No-SQL system, and the like), and may be cloud-based or otherwise.

EXAMPLES

Example 1

Identification of New Antimicrobial α-Core Helices

This example describes an experiment in which a consensus sequence formula was developed and used to search for new α-helical antimicrobial peptides (AHAPs) having microbiocidal activities.

Among the most potent natural antibiotics known to date include α-helical host defense peptides. These peptides effect a first line of defense against invading pathogens and have been isolated from species ranging from microbes to man. While many prior investigations have analyzed individual and class-specific properties through which these peptides convey function, machine-learning strategies to define unifying principles and underlying structure activity relationships (SARs) have been limited. In this example, a systematic formula encompassing features of idealized amphipathic and/or antimicrobial helices that span up to 18 positions of canonical right-handed α-helices was designed. The formula was then applied to search known protein databases seeking known as well as unforeseen proteins or peptides fulfilling its structural signature. Results demonstrate that nearly all families of known antimicrobial α-helical peptides align with this formula. Interestingly, logical search algorithms using this formula discovered many previously uncharacterized sequences predicted to have direct antimicrobial activity. Laboratory studies affirmed the veracity of predictions and established validity of the α-core formula and search strategy. As a result, new protein and peptide families and specific sequences are identified as having potent and direct microbicidal efficacy that heretofore had not been ascribed.

Methods and Materials

Identification of the α-Core Formula

To identify a consensus formula that was representative of nearly all classes of AHAPs, multiple sequence alignments with prototypical α-helical peptides using CLUSTAL W (www.ebi.ac.uk/Tools/msa/clustalw2/) were carried out. Alignments were then manually adjusted at certain positions using MEGA 6. Through iterative refinements of this process, an 18 residue generalized amphipathic formula emerged with sequence degeneracies at each position that was representative of nearly all classes of AHAPs. This formula can initiate at any of the positions that make up a standardized 18 residue α-helical wheel.

Assignment of Residue Polarity within the α-Core Formula

Within the formula, individual residues were categorized as either hydrophobic or hydrophilic as per the Wimley-White hydrophobicity scale, a scale that has been empirically derived and includes contributions from the peptide bond. One exception was for alanine (A), which was also included with the hydrophobic residues as per the Eisenberg and Kyte-Doolittle hydrophobicity scales. This assignment was made in-part due to preliminary studies that frequently localized alanine to the hydrophobic facet of many antimicrobial peptides.

Accuracy of Formula in Retrieving Helical Sequences

The amphipathic helical consensus formula above was queried against the PDB 3D database (www.wwpdb.org) to assess the fidelity of the formula in identifying helical domains. The first 100 non-redundant retrieved structures were scored for helicity of the target sequence. Proteins were considered to be a positive hit if the target sequence was more than 75% helical.

Use of α-Core Formula as a Database Query

The α-core sequence formula was used with the ScanProsite (prosite.expasy.org/scanprosite/) tool to carry out iterative pattern searches of the UniProtKB Swiss-Prot database. While initial searches queried the database with varying lengths of the amphipathic sequence formula, it was ultimately found that a relatively short query sequence of 12 residues was most efficient at retrieving the majority of antimicrobial peptide sequences. Iteration 1 of this query sequence is listed below:

(SEQ ID NO: 6861)
X-[VILMCFWYAG]-[KRHEDNQSTAG]-[KRHEDNQSTAG]-

[VILMCFWYAG]-[VILMCFWYAG]-[KRHEDNQSTAG]-

[KRHEDNQSTAG]-[VILMCFWYAG]-X-[KRHEDNQSTAG]-

[VILMCFWYAG]

After this optimization process, the sequence formula was used as a query against the UniProtKB Swiss-Prot and TrEMBL databases. The formula was advanced one position at a time through 18 iterations to represent an entire 18-residue helical wheel span. ScanProsite search results were further limited by: 1) protein size (<200 residues); 2) eukaryotic organisms; and 3) localization of the pattern to the C-terminal region using a "X(0,50)>" logical operator.

Signal Peptide and Biophysical Parameter Determination

Retrieved datasets were additionally screened for the presence of a signal peptide using SignalP 4.1 (www.cbs.dtu.dk/services/SignalP/). Hydrophobic moment ($\mu H$), mean hydrophobicity (H), net charge (Q–K and R (+1); H (+0.5); D and E (–1)) and K and R residue frequency were determined in batch using Python algorithms created for this purpose. PI was determined using the ExPasy Compute PI tool (web.expasy.org/compute_pi/).

Candidate Peptides and HDPs

Select candidate microbicidal peptides were commercially synthesized by BioMatik (Biomatik USA, Wilmington, Delaware). Lyophilized peptides were reconstituted with ddIH20 and stored in aliquots at –20° C. LL-37 (Peptides International, Louisville, KY), a prototypic human AHAP, was used as a comparator in microbicidal assays.

Assay for Antimicrobial Activity

Putative antimicrobial peptides were assayed for microbicidal activity using a well-established radial diffusion method modified to pH 5.5 or 7.5. A panel of microorganisms was tested: Gram-positive *Staphylococcus aureus* (ISP 479C, ISP 479R); Gram-negative *Salmonella typhimurium* (MS 5996s, MS 14028), *Pseudomonas aeruginosa* (PA01), *Acinetobacter baumanni* (19606) and the fungus *Candida albicans* (36082S, 36082R). Logarithmic phase organisms were inoculated ($10^6$ CFU/ml) into buffered agarose, and poured into plates. Peptides (10 µg) were introduced into wells in the seeded matrix, and incubated for 3 h at 37° C. Nutrient overlay medium was applied, and assays incubated at 37° C. or 30° C. for bacteria or fungi, respectively. After 24 h, zones of inhibition were measured. Independent experiments were repeated a minimum of two times.

Results

Derivation and Iterative Refinement of the α-Core Sequence Formula

Figure 1B:
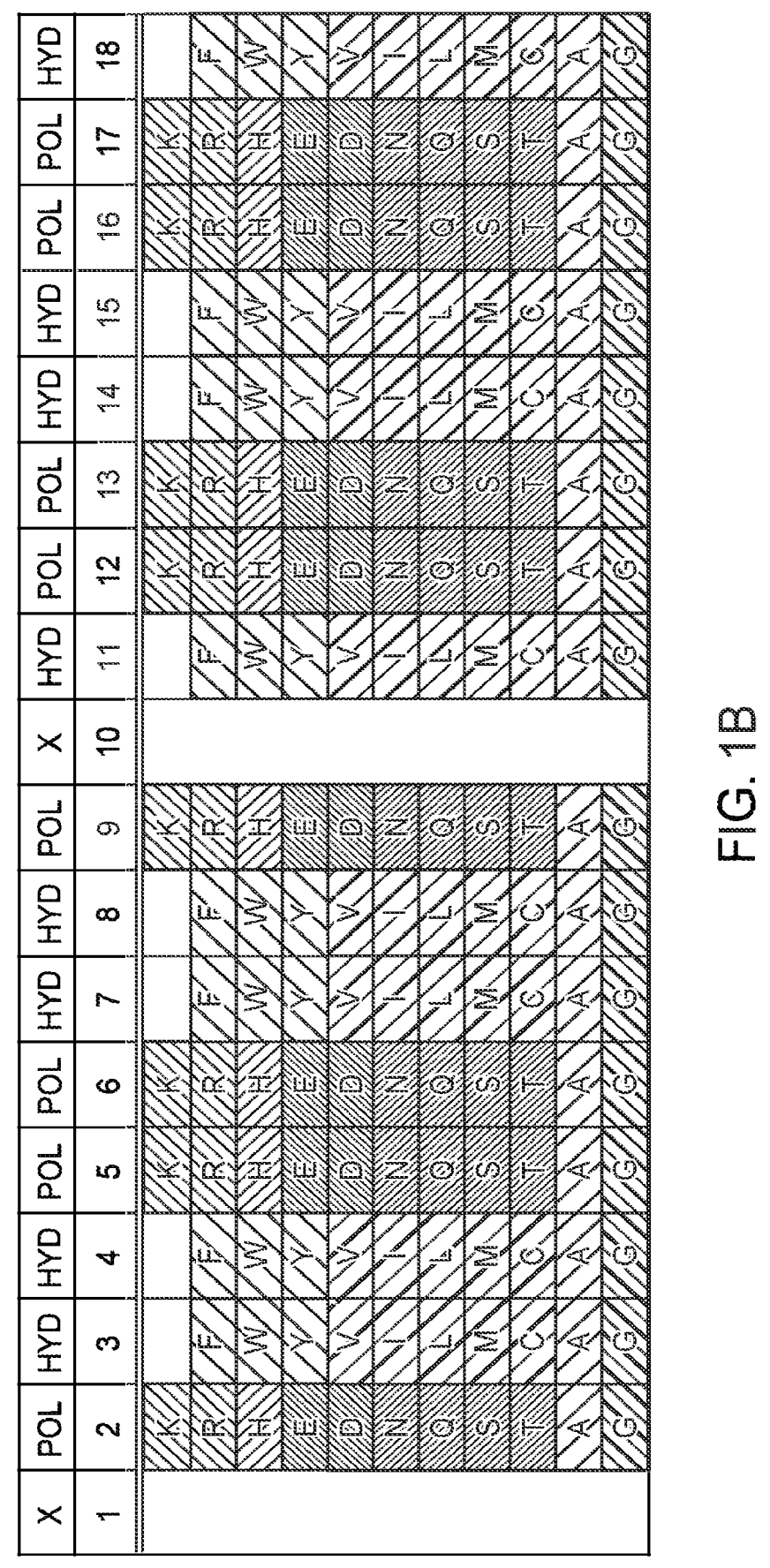
Figure 2:
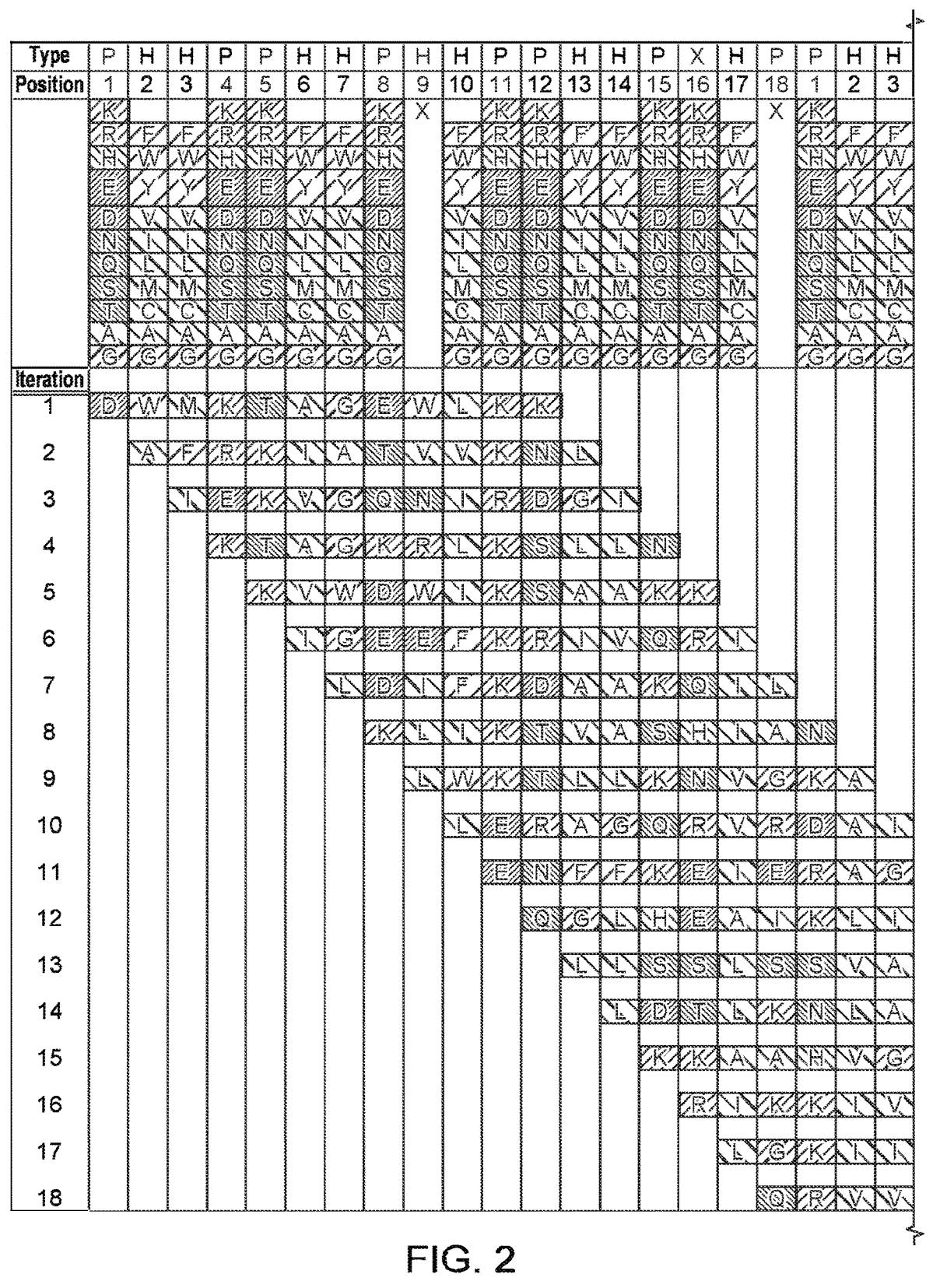

In initial studies, alignments with prototypic representatives from all of the major classes of AHAPs were carried out to identify conserved sequence elements. This analysis revealed that nearly all of these prototypes could be aligned with a degenerate sequence formula wherein either polar or non-polar residues were assigned to positions along an amphipathic helix. Peptides adhered to this formula ranging from a minimal 11 to maximal 16 residue span corresponding to 3 to 4.5 turns of an α-helix. Based on this analysis, a consensus formula representative of nearly all of the major classes of AHAPs was extracted (FIGS. 1A-B and 2).

Once this preliminary consensus was defined, it was further refined by testing its efficiency to return α-helical domains when used as a query against the PDB protein structure database. As a baseline, versions of the formula lacking known helix breakers proline and glycine were carried out. Results of these analyses revealed that the efficiency of the formula in retrieving α-helical domains was very high, identifying these motifs (defined as spans that were at least 75% helical) with a frequency of 92-94%.

As many AHAPs are known to contain proline and glycine residues, subsequent tests to evaluate the impact of these residues on the efficiency of the formula were carried out. When proline was included within the sequence formula, α-helical domains within target sequences were retrieved less than 10% of the time. These findings strongly support the theory that proline, due to its side chain and steric constraints, is inconsistent with stable α-helix formation. Because of this, proline was excluded from the formula.

In contrast when glycine was allowed within the sequence formula, queries against the structure database revealed two different outcomes depending on whether targets had been determined in aqueous or non-polar environments. For structures determined in aqueous environments, the sequence formula retrieved α-helical domains approximately 74% of the time when a single glycine was present; a value that was reduced to 40% when two or more glycine residues were present. By comparison, when target structures were determined in non-polar environments (high levels of TFE, SDS, or micellar components), the presence of glycine had very little impact on peptide helicity. These studies revealed that the sequence formula retrieved α-helical domains approximately 92% if the time when as many as four glycine residues were present in the target sequence. Because of this, and since glycine is highly represented in AHAPs, this residue was included in the sequence formula. Moreover, a large number of biophysical studies have demonstrated that while many glycine-rich AHAPs are unstructured in aqueous environments, they nearly always adopt an α-helical conformation when interacting with the hydrophobic membrane environments of their microbial targets.

Alanine/Glycine Both Faces of Helix

Figure 3:
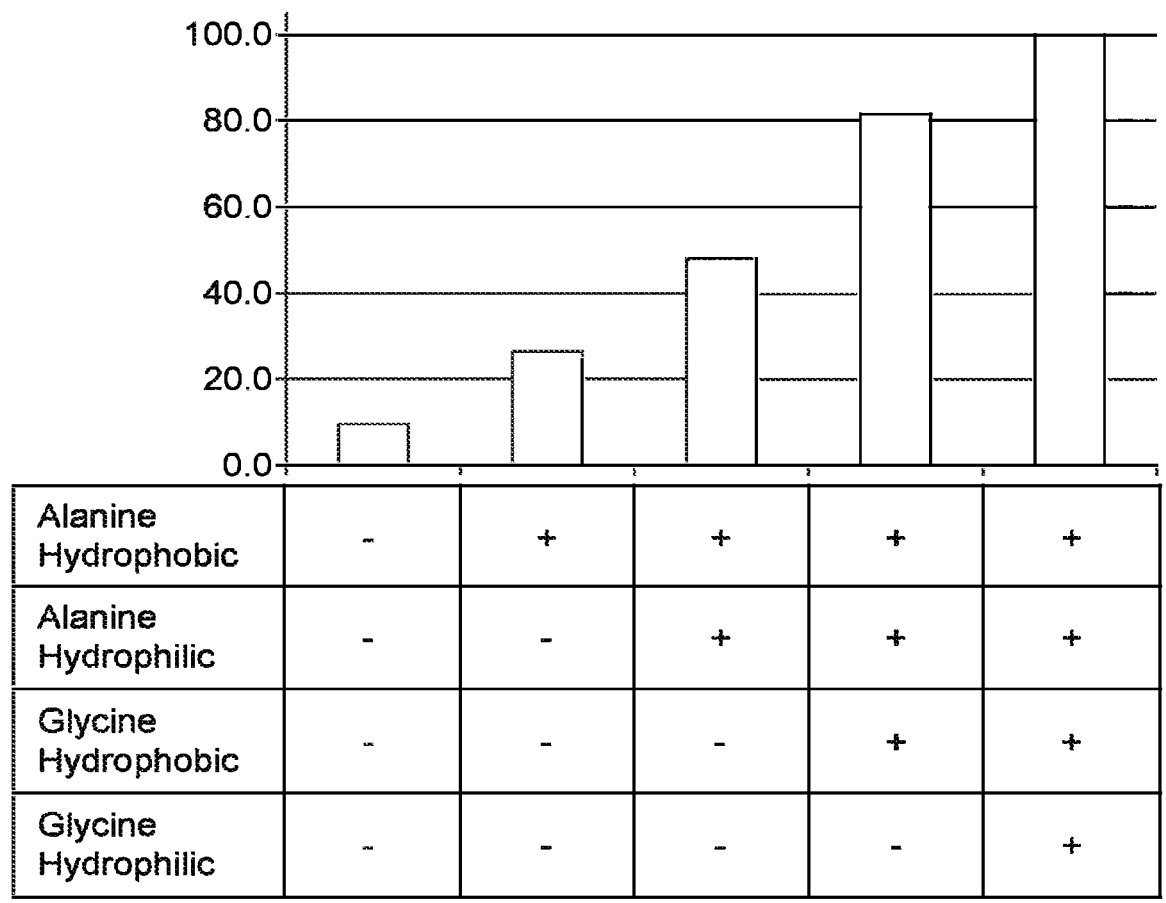
FIG. 3 illustrates the iterative optimization of the α-core formula. Iterative refinement of the α-core formula was carried out to assess the requirement for glycine and/or alanine as a component of either the polar (hydrophilic) or non-polar (hydrophobic) residue set. Percentage of returned sequences from a control AHAP dataset of more than 400 peptides are shown.

While the assignment of most residues to either the polar or non-polar residue group within the sequence formula was relatively straightforward based on the initial AHAP consensus and known residue-specific hydrophobicity values, the placement of alanine and glycine was less obvious due to their relatively neutral ΔG values in polar and non-polar environments. Because of this, the requirement for glycine and/or alanine on either the polar or non-polar face of the helix was assessed in an iterative manner via queries against a control dataset comprised of more than 400 AHAP peptides (FIG. 3). Preliminary versions of the formula, lacking alanine and glycine, failed to retrieve significant numbers (>10%) of the control AHAP study set (FIG. 3). The inclusion of alanine on the polar face of the amphipathic helix increased the retrieved fraction of peptides to 26%, and when alanine was added to both the polar and non-polar search terms the retrieved AHAPs increased to 48%. With respect to glycine a similar relationship was found. The addition of glycine to the polar face of the query sequence led to the identification of approximately 81% of the control AHAP dataset, and when glycine was included on both the polar and non-polar facets, the query retrieved close to 99% of the AHAP study set. As a result of this analysis, alanine and glycine were included as components of both the polar and non-polar query search terms.

α-Core Sequence Formula

Based on the above considerations, a linear α-core formula spanning all 18 positions of a canonical right-handed alpha helix was created, as shown below. When translated into three dimensions, the formula describes an idealized amphipathic helix, with distinct hydrophobic and hydrophilic facets. Positions in between the polar and nonpolar faces were assigned a value of "X" within the linear formula, leading to a polar angle (θ) maxima of 180° and minima of 140°. Due to the degenerate nature of the formula, each position along the helical span was represented by multiple polar or non-polar residues (below and FIGS. 1A-B and 2).

$Pos_{(n\ 0-17)} = [(\sin n\delta), (\cos n\delta)]$
$\delta = 100$ for standard α-helix

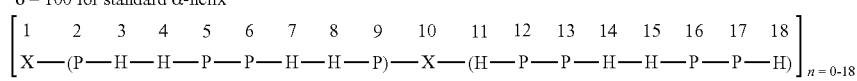

P (polar) = [EDKRHQNTSAG]
H (hydrophobic) = [VMCILFWYAG]

Primary Database Searches Using the α-Core Sequence Formula

Figure 4:
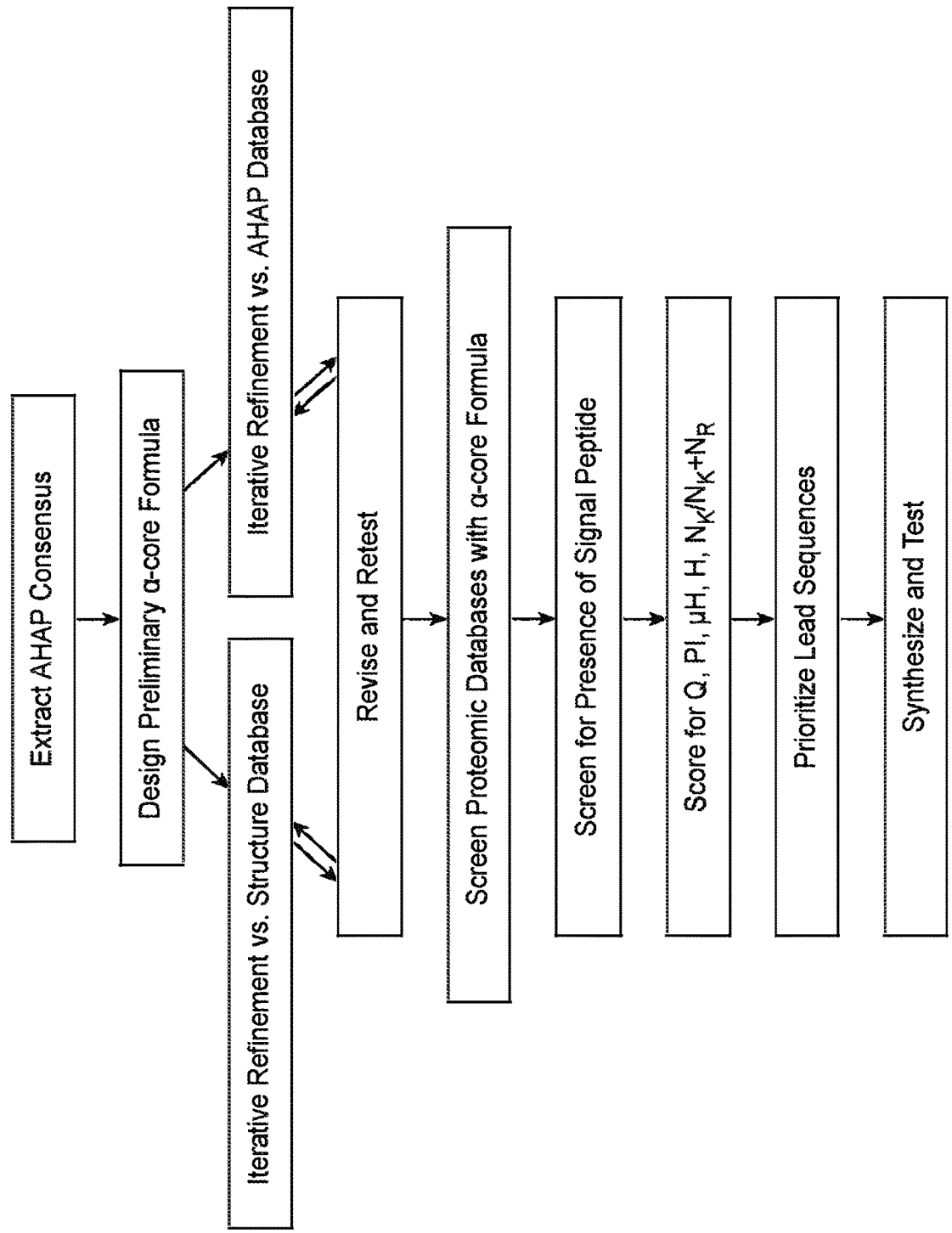
FIG. 4 illustrates a process of identifying new AHAP sequences.

Once refined, the α-core sequence formula was used as a query against the SwissProt and TrEMBL protein sequence databases (FIG. 4). As described in Methods, database queries were further limited to sequences that were eukaryotic in origin, less than 200 residues in length and within 50 residues of the C-terminus.

Returned raw datasets consisted of more than 70,000 sequences, often representing multiple target hits shifted along amphipathic helical spans of a single protein. Each of these returned hits was scored for hydrophobic moment, and sequences with the highest μH were extracted to generate a non-redundant dataset of approximately 13,000 unique sequences for downstream studies. Dataset proteins were also scored for the presence of a signal peptide, and sequences lacking this motif were removed to generate a final dataset of approximately 3,800 sequences.

Efficiency of the α-Core Sequence Formula

The results of the above database queries indicated that the amphipathic sequence algorithm was highly robust, retrieving members from nearly all of the known AHAP families (Table 1). Overall, the formula retrieved at least one member of more than 106 different helical peptide families representing approximately 94%, of all known AHAP classifications. Moreover, while the formula describes an idealized amphipathic helical structure, it nonetheless returned 827 individual antimicrobial peptide sequences, representing approximately 88% of all known AHAPs in the SwissProt database.

TABLE 1

α-Helical Peptide Families Retrieved with Alpha-Core Formula Search

|  | Class | Peptide | Organism |
|---|---|---|---|
| 1 | Cnidaria | Clavanins | Sea squirt |
| 2 |  | Clavaspirin | Sea squirt |
| 3 |  | Halocidin | Sea peach |
| 4 |  | Halocyntin | Sea squirt |
| 5 |  | Styelins | Sea squirt |
| 6 | Plants | Ginkbilobin | Ginko |
| 7 |  | Thionin (helical domain) | Wheat |
| 8 | Arthropods | Amphipathic peptides | Scorpion |
| 9 |  | Andropin | Fruit fly |
| 10 |  | Anionic Antimicrobial peptide 2 | Moth |
| 11 |  | Antifungal Protein MAF-1 | Fly |
| 12 |  | Antimicrobial peptides (36.4, 143) | Scorpion |
| 13 |  | Antimicrobial peptide ctriporin | Scorpion |

(SEQ ID NO: 6866)

TABLE 1-continued

α-Helical Peptide Families Retrieved with Alpha-Core Formula Search

|  | Class | Peptide | Organism |
|---|---|---|---|
| 14 |  | Antimicrobial peptide HsAp1 | Scorpion |
| 15 |  | Bactericidin | Moth |
| 16 |  | Bombolitin | Bee |
| 17 |  | Cecropins | Moth/fly |
| 18 |  | Cecropin-D-like peptide | Moth |
| 19 |  | Cryptonin | Cicada |
| 20 |  | Cytotoxic linear peptide | Scorpion |
| 21 |  | Decoralin | Wasp |
| 22 |  | Dominulins | Wasp |
| 23 |  | Eumenitins | Wasp |
| 24 |  | Hadrurin | Scorpion |
| 25 |  | Im-1 | Scorpion |
| 26 |  | Imcroporin | Scorpion |
| 27 |  | Lebocin-like peptide | Moth |
| 28 |  | Mastoparans | Wasp |
| 29 |  | Mastoparan-like peptides | Wasp |
| 30 |  | Melittin | Bee |
| 31 |  | Meucin-49 | Scorpion |
| 32 |  | Moricins | Moth |
| 33 |  | Moricin-like peptide A | Moth |
| 34 |  | Mucroporin | Scorpion |
| 35 |  | Mucroporin-like peptide | Scorpion |
| 36 |  | Non-disulfide-bridged peptides | Scorpion |
| 37 |  | Oxyopinin 4a | Spider |
| 38 |  | Pandinin | Scorpion |
| 39 |  | Parabutoporin | Scorpion |
| 40 |  | Peptide BmKb1 | Scorpion |
| 41 |  | Peptides Ctry | Scorpion |
| 42 |  | Peptides Hp (Non-disulfide bridged) | Scorpion |
| 43 |  | Pilosulins | Ant |
| 44 |  | Ponericins | Ant |
| 45 |  | Ponericin W-like | Scorpion |
| 46 |  | Protonectin | Wasp |
| 48 |  | Stomoxyn | fly |
| 49 | Fish | Chrysophsin | Sea Bream |
| 50 |  | Pleurocidin | Flounder |
| 51 |  | Pleurocidin-like peptide | Flounder |
| 52 |  | Grammistins | Soapfish |
| 53 |  | Pardaxins | Sole |
| 54 |  | Piscidin 3 | Striped bass |
| 55 | Amphibians | Ascaphin | Frog |
| 56 |  | Aureins | Frog |
| 57 |  | Antimicrobial peptide PGQ | Frog |
| 58 |  | Antimicrobial peptides | Frog |
| 59 |  | Brevinins | Frog |

TABLE 1-continued

α-Helical Peptide Families Retrieved
with Alpha-Core Formula Search

| | Class | Peptide | Organism |
|---|---|---|---|
| 60 | | Bombesin | Toad |
| 61 | | Bombinins | Toad |
| 62 | | Bombinin-like peptides | Toad |
| 63 | | Caeridin | Frog |
| 64 | | Caerins | Frog |
| 65 | | Citropins | Frog |
| 66 | | Cyanophlyctin | Frog |
| 67 | | Dahleins | Frog |
| 68 | | Dermadistinctins | Frog |
| 69 | | Dermaseptins | Frog |
| 70 | | Dermaseptin-like peptides | Frog |
| 71 | | Dermatoxin | Frog |
| 72 | | Distinctin-like peptide | Frog |
| 73 | | Esculentins | Frog |
| 74 | | Fallaxidins | Frog |
| 75 | | Frenatins | Frog |
| 76 | | Gaegurin | Frog |
| 77 | | Grahamins | Frog |
| 78 | | Guentherin | Frog |
| 79 | | Hylins | Frog |
| 80 | | Maximins | Toad |
| 81 | | Nigrocins | Frog |
| 82 | | Ocellatins | Frog |
| 83 | | Palustrins | Frog |
| 84 | | Phylloseptins | Frog |
| 85 | | Pseudins | Frog |
| 86 | | Prolevitide | Frog |
| 87 | | Ranatuerins | Frog |
| 88 | | Rugosins | Frog |
| 89 | | Syphaxin | Frog |
| 90 | | Temporins | Frog |
| 91 | | Xenopsin | Frog |
| 92 | | Uperins | Frog |
| 93 | Reptiles | CRAMPs | Snake |
| 94 | Birds | Cathelicidins | Chicken |
| 95 | Mammals | Cathelicidins | Mammals |
| 96 | | Cathelicidin related peptide SC5 | Sheep |
| 97 | | CRAMP | Mouse |
| 98 | | CAP-18 | Rabbit |
| 99 | | PMAP-37 | Pig |
| 100 | | Chemokines (helical domain) | Mammals |
| 101 | | CXCL | |
| 102 | | CCL | |
| 103 | | XCL | |
| 104 | | Granulysin | Human |
| 105 | | Dermcidin | Human |
| 106 | | NK-lysin | Horse |

Beyond retrieving a high proportion of known AHAPs, when limited to sequences with a PI of 8.5 or greater, the formula was also relatively specific in returning these sequences. Searches were carried out in several stages of either 0-50, or 51-200 residues, depending on whether a signal peptide test was applied. For the 0-50 residue set, approximately 71% of the retrieved sequences were known AHAPs; whereas, for the 51-200 residue set, approximately 27% of the identified sequences were α-helical antimicrobial proteins. Given that there are approximately 940 (see methods) named AHAPs in the 553,000 sequence SwissProt database (version 12-1-16), this represents and in-silico enrichment of approximately 130-fold.

With respect to other proteins retrieved by the sequence formula, the second most highly represented group were a variety of toxin peptides making up approximately 17% of the dataset. Beyond this, other protein families that were abundant in the retrieved dataset included: apovitellins, leptins, vasoactive intestinal proteins and uncharacterized proteins.

Residue Frequency

Figures 5A, 5B, 5C:
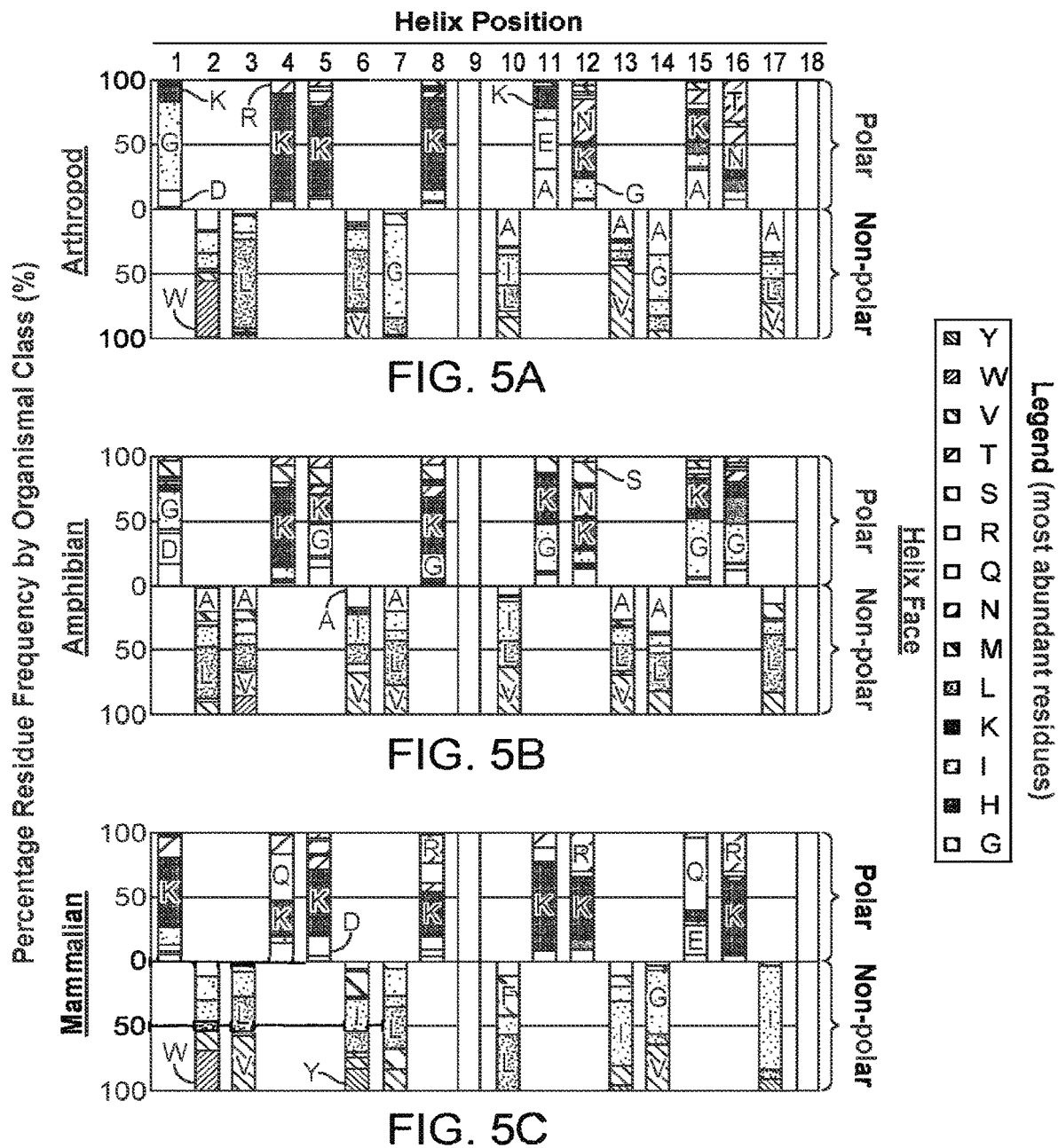
FIG. 5A-5C show the positional and spatial amphipathic residue frequency by class (arthropods, amphibians, higher vertebrates, respectively). Percentages of individual residues on either the polar or non-polar peptide face of study peptides are represented as various color blocks. Residues above the x-axis are found on the polar face of retrieved peptides and residues below the axis are found on the non-polar face.

Given that the α-core sequence formula returns aligned datasets, it was possible to score identified AHAP helices for the abundance of various residues at each position along an 18 residue amphipathic span. Moreover, given that the α-core formula identifies amphipathic patterns that are likely to form helices, it was also possible to make assumptions about the localization of specific resides to either the polar or non-polar facet of these structures. Due to the significant evolutionary distance between invertebrate and lower and higher vertebrate classes of AHAPs, the dataset was divided into three groups representing arthropod, amphibian and mammalian sequences (FIG. 5).

The analysis of residue frequency revealed a number of findings regarding the composition and hydrophilic and hydrophobic distribution of residues within returned AHAP helices. One finding of note was that glycine was highly represented in AHAPs of lower organisms, comprising approximately 30-35% of all residues in target amphipathic spans in arthropods and amphibians. While glycine was still abundant in mammals, it occurred less frequently representing about 15% of residues in the returned sequences.

It was also of interest to find that alanine, while abundant in amphipathic spans of arthropods and amphibians, was much less common in the identified sequences of mammals. Moreover, while alanine was found more frequently on the hydrophobic face of the peptide, it was also found with some frequency 10-30% on the polar face of peptides from arthropods and amphibians.

With respect to charged residues, it is of interest that lysine was the most abundant polar residue in non-mammalian species (30%) and was strongly preferred over arginine at an approximately 12:1 ratio. By contrast, in mammals this preference was markedly reduced, with this ratio decreasing to a 3:1 abundance of lysine to arginine. It is also of note to find negatively charged aspartic and glutamic acid residues within the returned sequences at a low frequency of approximately 5% in all species groups.

Biophysical Signatures

Beyond measuring the frequency of specific residues within returned AHAP helices, sequences were also scored for a number of biophysical parameters including: net charge (Q), isoelectric point (PI), hydrophobic moment (µH), hydrophobicity (H), and lysine to arginine (K/K+R) ratio.

In this analysis it was found that the average net charge for the AHAP subset of study helices (n=803) was +2.0. If only cationic sequences (Q≥0.5; n=707) were considered this value rises to +2.7. By comparison the mean net charge for study toxin helices (n=717) was +1.3, and +0.6 for other study helices. With respect to hydrophobic moment, AHAP helices had an average µH of 0.52 while toxins had an average µH 0.42 and other peptides 0.39. While some reports suggest that mean hydrophobicity may be greater for toxins than for AHAPs, in this study values for hydrophobicity in the retrieved helices were similar, with an average H of 0.42 for AHAPs, and 0.34 for toxins as compared with other peptides (0.39).

Negative Gaussian Curvature

Figure 6:
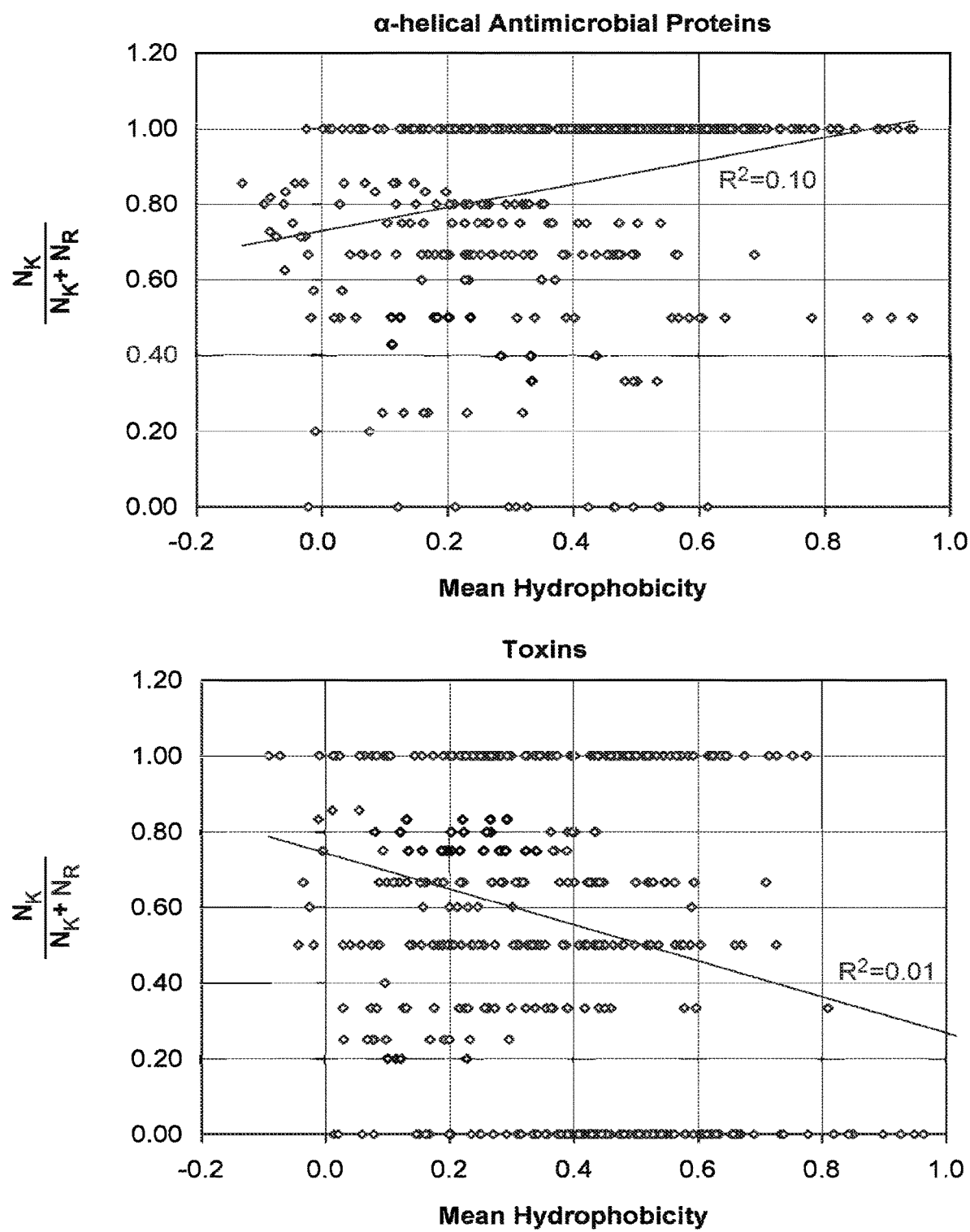
FIG. 6 shows the comparison of $N_K/N_K+N_K$ ratio and hydrophobicity in AHAP and toxin helices. Percentage of lysine ($N_K$) relative to arginine ($N_R$) expressed as ($N_K/N_K+N_K$) versus hydrophobicity (H) in study AHAPs and toxins. Preference of lysine as compared to arginine is reflected in an increased value of H for peptides capable of generating NGC in membranes as predicted by the saddle-splay rule.

Retrieved sequences were also scored for their ratio of lysine to arginine ($N_K/N_K+N_R$) residues. Prior studies have demonstrated that the relative abundance of these residues can significantly impact the propensity of a given peptide to induce negative Gaussian curvature (NGC) in membranes, a phenomenon that is associated with pore formation and membrane permeabilization. Prior studies have demonstrated that the residue lysine is favored over arginine in AHAPs, a substitution that necessitates an increased level of peptide hydrophobicity to efficiently induce NGC. In the present example, retrieved AHAP helices largely adhered to this rule, demonstrating a modest positive association between $N_K/N_K+N_R$ ratio and peptide hydrophobicity (FIG. 6). By comparison, amphipathic helices from toxins did not comply with this observation, where a negative relationship between $N_K/N_K+N_R$ ratio and peptide hydrophobicity was found.

Application of the α-Core Sequence Formula to Retrieve Previously Uncharacterized Antimicrobial Sequences In addition to the known classes of antimicrobial proteins, the α-core formula also retrieved many uncharacterized proteins, or proteins with an alternate primary function. Based on the efficiency with which the formula retrieved antimicrobial peptides, it was of interest to determine whether some of these additional sequences might represent: 1) as yet uncharacterized antimicrobial proteins; or 2) proteins with an assigned function that also have an as yet unidentified antimicrobial function or antimicrobial domain within a larger protein.

Figure 7:
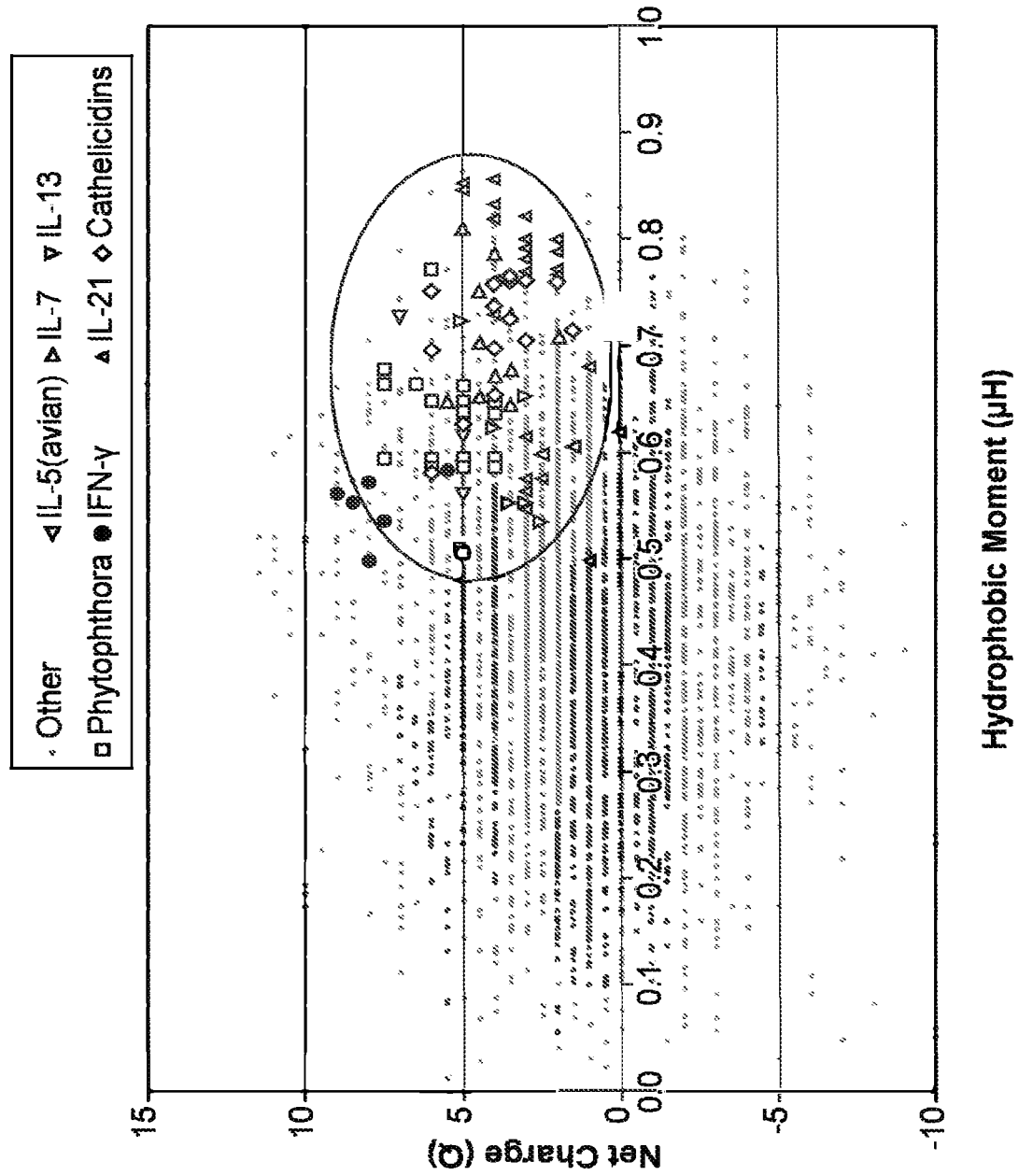
FIG. 7 shows the mapping of net charge vs. hydrophobic moment in study peptides (IL-5 (SEQ ID NO:1); IL-7 (SEQ ID NO:2); IL-13 (SEQ ID NO:3); IL-21 (SEQ ID NO:4); IFN-γ (bIFN-γ (SEQ ID NO:5); hIFN-γ (SEQ ID NO:6)); *Phytophthora* (Pp-1 (SEQ ID NO:7); Pp-2 (SEQ ID NO:8); Pp-3 (SEQ ID NO:9); Pp-4 (SEQ ID NO:10))). Values for net charge (Q) versus hydrophobic moment (μH) are shown for the retrieved peptide dataset. All retrieved sequences are shown in gray. Peptide groups selected for further characterization are shown in color. For comparison, prototypic AHAPs are shown in pink.
Figure 8:
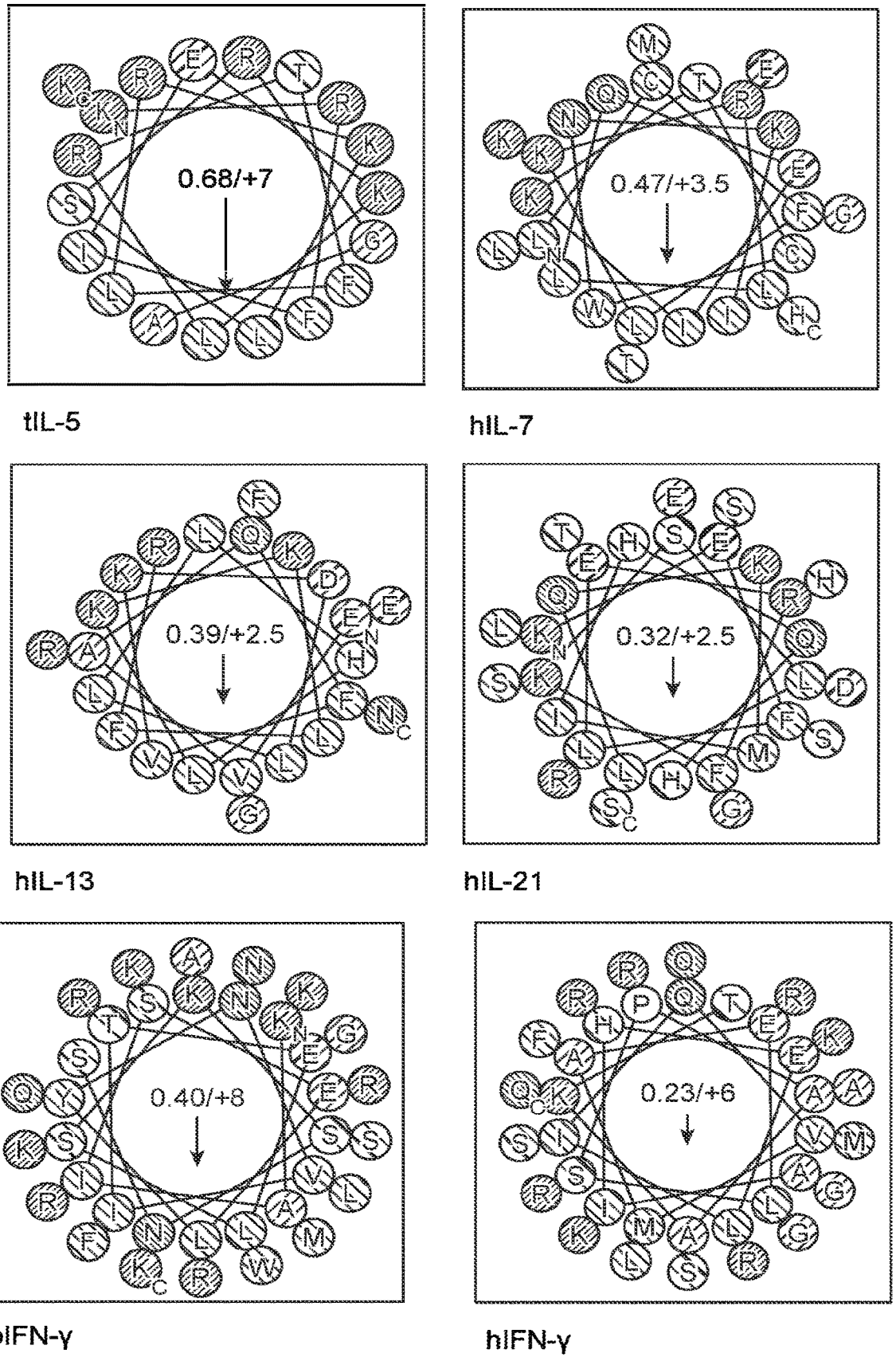
FIG. 8 shows helical wheel depiction of study test peptides (IL-5 (SEQ ID NO:1); IL-7 (SEQ ID NO:2); IL-13 (SEQ ID NO:3); IL-21 (SEQ ID NO:4); bIFN-γ (SEQ ID NO:5); hIFN-γ (SEQ ID NO:6); Pp-1 (SEQ ID NO:7); Pp-2 (SEQ ID NO:8); Pp-3 (SEQ ID NO:9); Pp-4 (SEQ ID NO:10)). Hydrophobic moment (μH) and vector angle direction are indicated. Coloration: cationic full charge (KR)—blue, partial charge (H)—light blue; anionic—red; polar—yellow; tiny—gray; polar (NQ)—pink, (TS)—purple.
Figure 8:
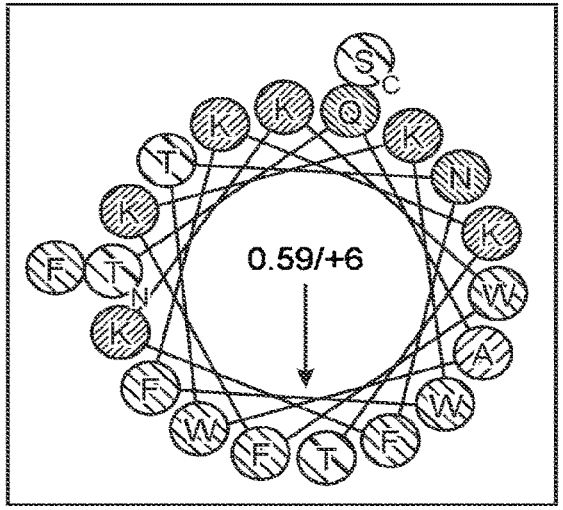
Figure 8:
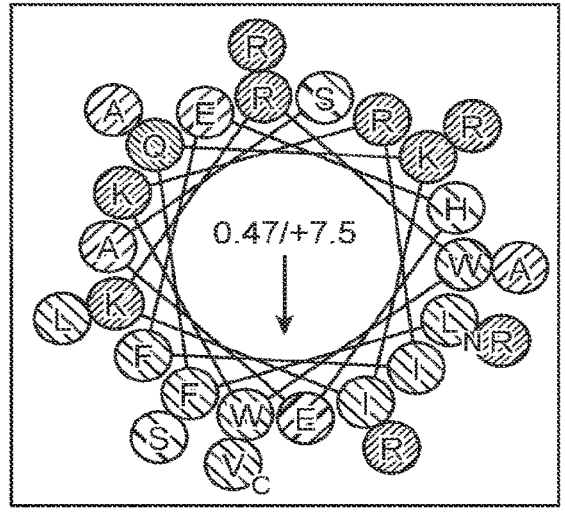
Figure 8:
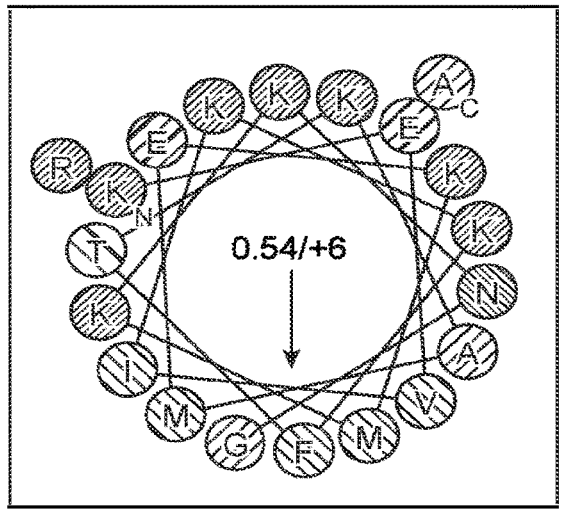
Figure 8:
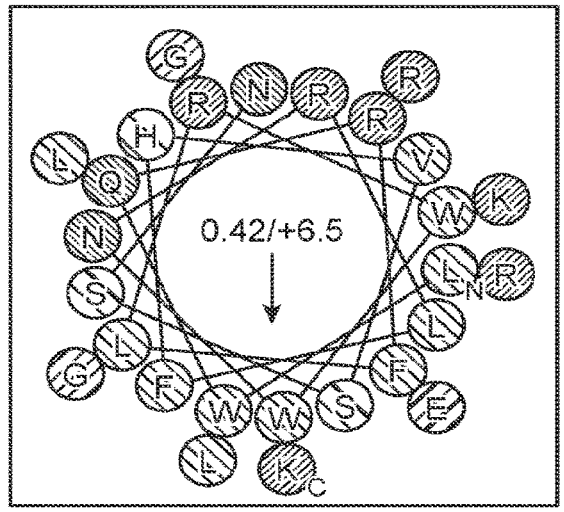

To identify putative microbicidal sequences, study set peptides were scored for the biophysical parameters described above (µH, Q, H, K/K+R, PI) and analyzed to determine which factors and/or relationships were most efficient at separating known AHAPs from non-microbicidal sequences. Results from these analyses, demonstrated that mean amphipathicity (µH) and either net charge (Q) (FIG. 7) or PI were the most efficient means of discriminating bona-fide AHAPs from other sequences.

Based on the above analyses, dataset proteins were scored for either cationicity or PI and hydrophobic moment (Q*µH) or (PI*µH) and sequences of interest were prioritized. While this analysis retrieved many peptides of interest, several families of biological significance were consistently found amongst the top scoring sequences. These included members of the γ-chain-dependent interleukin family along with many interferon sequences. Moreover, a number of consistently high scoring peptides were also derived from the globally-impactful plant pathogen *Phytophthora* parasitica.

Given the above considerations, ten lead candidates representing these families were synthesized so that their antimicrobial properties could be determined (Table 2). As shown in Table 2, they included:

Interleukins
IL-5—*Meleagris gallopavo* (common turkey) (SEQ ID NO:1)
IL-7—human (SEQ ID NO:2)
IL-13—human (SEQ ID NO:3)
IL-21—human (SEQ ID NO:4)
Interferons
IFN-γ—*Myotis davidii* (vesper bat) (SEQ ID NO:5)
IFN-γ—human (SEQ ID NO:6)
*Phytophthora parasitica* uncharacterized sequences
Pp-1—*P. parasitica* (SEQ ID NO:7)
Pp-2—*P. parasitica* (SEQ ID NO:8)
Pp-3—*P. parasitica* (SEQ ID NO:9)
Pp-4—*P. parasitica* (SEQ ID NO:10)

Two additional candidates were identified when the localization of the pattern relative to the C-terminal region was relaxed. These two candidates, along with two respective longer versions are listed in Table 3. Additional listings of identified peptides are provided in Table 4, and SEQ ID NO:518-6029 (localization required) and SEQ ID NO:6030-6860 (localization requirement relaxed).

TABLE 2

Study set peptides

| Short Name | Peptide | Accession | Species | Sequence | Charge | µH | SEQ ID NO: |
|---|---|---|---|---|---|---|---|
| tIL-5 | IL-5 | G1N9U6 | *Meleagris gallopavo* | KRFIEKLRTF LRKLSRGAK | +7 | 0.68 | 1 |
| hIL7 | IL-7 | P13232 | *Homo sapiens* | LCFLKRLLQE IKTCWNKILM GTKEH | +3.5 | 0.47 | 2 |
| hIL-13 | IL-13 | P35225 | *Homo sapiens* | EVAQFVKDLL LHLKKLFREG RFN | +2.5 | 0.39 | 3 |
| hIL-21 | IL-21 | Q9HBE4 | *Homo sapiens* | KEFLERFKSL LQKMIHQHLS SRTHGSEDS | +2.5 | 0.32 | 4 |
| bIFN-γ | IFN-g | L5LME8 | *Myotis davidii* | KAISELYNVI TELSKSNSKM RKRRQNLFRG WKASK | +8 | 0.40 | 5 |
| hIFN-γ | IFN-g | P01579 | *Homo sapiens* | AIHELIQVMA ELSPAAKTGK RKRSQMLFRG RRASQ | +6 | 0.23 | 6 |
| Pp-1 | | W2QY53 | *Phytophthora parasitica* | TQAWTNFKKW FKKWFKKTFS | +6 | 0.59 | 7 |
| Pp-2 | | W2N8A5 | *Phytophthora parasitica* | LFQKIKRWWK RIFEHEASRS ARRLRAV | +7.5 | 0.47 | 8 |
| Pp-3 | | W2HTE6 | *Phytophthora parasitica* | KEVIKKFTKA MEKMKKNGRA | +6 | 0.54 | 9 |
| Pp-4 | | A0A080YYV3 | *Phytophthora parasitica* | LWQRFLRWWN RLFHVSSNRL LREGGKK | +6.5 | 0.42 | 10 |

TABLE 3

Additional peptides identified with relaxed localization requirement

| Peptide | Accession | Species | Sequence | Length | Charge | µH | SEQ ID NO: |
|---|---|---|---|---|---|---|---|
| Dynorphin A (short) | P01213 | Homo sapiens | YGGFLRRIRP KLKWDNQ | 17 | +4 | 0.32 | 11 |
| Dynorphin (long) | P01213 | Homo sapiens | YGGFLRRIRP KLKWDNQKRY GGFLRRQFKV VT | 32 | +9 | 0.16 | 13 |
| Oncostatin M (short) | P13725 | Homo sapiens | KEFLERFKSL LQKMIHQHLS SRTHGSEDS | 29 | +2.5 | 0.32 | 12 |
| Oncostatin M (long) | P13725 | Homo sapiens | RFLHGYHRFM HSVGRVFSKW GESPNRSRRH SPHQALRKGV RRTRPSRKGK RLMTRGQLPR | 60 | +19.5 | 0.32 | 14 |

TABLE 4

Priority alpha core peptide sequences

| Accession # | Name | Comp Form Match | HM | Q | HM*Q | PI | SEQ ID NO: |
|---|---|---|---|---|---|---|---|
| W7G0H8 | Uncharacterized protein | RIKKFLKRCCKKIK | 0.82 | 8 | 6.52 | 6.17 | 19 |
| W4IIC4 | Uncharacterized protein | RIKKFLKRCCKKIK | 0.82 | 8 | 6.52 | 6.03 | 20 |
| A0A024W805 | Uncharacterized protein | RIKKFLKRCCKKIK | 0.82 | 8 | 6.52 | 6.03 | 21 |
| U3KN10 | Uncharacterized protein | FLKKLLQKIKTCWNKILRGIKE | 0.75 | 6 | 4.51 | 8.7 | 22 |
| A0A016VH75 | Uncharacterized protein | KRVKRFCKKACRKASQ | 0.56 | 8 | 4.47 | 9.2 | 23 |
| A0A016VGG2 | Uncharacterized protein | KRVKRFCKKACRKASQ | 0.56 | 8 | 4.47 | 9.2 | 24 |
| G1N9U6 | Uncharacterized protein | KNVKRFIEKLRTFLRKLS | 0.72 | 6 | 4.34 | 9.44 | 25 |
| Q8SUJ0 | Uncharacterized protein | LVRKIIKYCRKL | 0.86 | 5 | 4.28 | 5.53 | 26 |
| M1JIG5 | Uncharacterized protein | LVRKIIKYCRKL | 0.86 | 5 | 4.28 | 5.53 | 27 |
| T1HZ04 | Uncharacterized protein | FRRLCRNIKEVIKK | 0.85 | 5 | 4.25 | 6.15 | 28 |
| A0A080YVY9 | Uncharacterized protein | TQAWTNFKKWFKKWFKK | 0.69 | 6 | 4.13 | 9.23 | 29 |
| W2QY53 | Uncharacterized protein | TQAWTNFKKWFKKWFKK | 0.69 | 6 | 4.13 | 9.23 | 30 |
| W2W791 | Uncharacterized protein | TQAWTNFKKWFKKWFKK | 0.69 | 6 | 4.13 | 9.23 | 31 |
| W2G110 | Uncharacterized protein | TQAWTNFKKWFKKWFKK | 0.69 | 6 | 4.13 | 9.23 | 32 |
| E0AD11 | Interleukin-5 | VKKFIEKLRTFIRKL | 0.82 | 5 | 4.08 | 9.06 | 33 |
| Q5W4T8 | Interleukin-5 | VKKFIEKLRTFIRKL | 0.82 | 5 | 4.08 | 8.88 | 34 |
| F1P2P6 | Uncharacterized protein | VKKFIEKLRTFIRKL | 0.82 | 5 | 4.08 | 8.88 | 35 |

TABLE 4-continued

Priority alpha core peptide sequences

| Accession # | Name | Comp Form Match | HM | Q | HM*Q | PI | SEQ ID NO: |
|---|---|---|---|---|---|---|---|
| A0A093FG05 | Interleukin-21 (Fragment) | KEFLKSFAKLIRKVIR | 0.80 | 5 | 4.02 | 9.54 | 36 |
| A0A094LKV9 | Interleukin-21 (Fragment) | KEFLKSFAKLIKKVIR | 0.80 | 5 | 4.01 | 9.57 | 37 |
| A0A091RQW4 | Interleukin-21 (Fragment) | KEFLKSFAKLIKKVIR | 0.80 | 5 | 4.01 | 9.49 | 38 |
| A0A091U0R6 | Interleukin-21 (Fragment) | KEFLKSFAKLIKKVIR | 0.80 | 5 | 4.01 | 9.44 | 39 |
| A0A091WDE2 | Interleukin-21 (Fragment) | KEFLKSFAKLIKKVIR | 0.80 | 5 | 4.01 | 9.37 | 40 |
| A0A091Q048 | Interleukin-21 (Fragment) | KEFLKSLAKLIKKVIR | 0.80 | 5 | 3.99 | 9.61 | 41 |
| Q32620 | Uncharacterized 3.3 kDa protein in psbT-psbN intergenic region (ORF27) | FFKWISKFIRRLSKCG | 0.79 | 5 | 3.95 | 10.74 | 42 |
| H2WTG9 | Uncharacterized protein | ANKANRMMRKIMRKL | 0.66 | 6 | 3.94 | 4.9 | 43 |
| F6W4B4 | Uncharacterized protein (Fragment) | WYQLIRTFGNLIHQKYRKL LEAYRKLR | 0.59 | 6.5 | 3.86 | 9.3 | 44 |
| P56478 | Interleukin-7 (IL-7) | FLKRLLREIKTCWNKILKG | 0.77 | 5 | 3.83 | 8.91 | 45 |
| Q544C8 | Interleukin 7 (Interleukin 7, isoform CRA_b) | FLKRLLREIKTCWNKILKG | 0.77 | 5 | 3.83 | 8.73 | 46 |
| P10168 | Interleukin-7 (IL-7) | FLKRLLREIKTCWNKILKG | 0.77 | 5 | 3.83 | 8.73 | 47 |
| A0A078IDV8 | BnaC03g69180D protein | IIKVITRALRGARRLLKY | 0.64 | 6 | 3.81 | 10.16 | 48 |
| G7MZL5 | Interleukin-7 (Fragment) | FLKRLLQKIKTCWNKIL | 0.76 | 5 | 3.79 | 9.21 | 49 |
| G7PC28 | Interleukin-7 (Fragment) | FLKRLLQKIKTCWNKIL | 0.76 | 5 | 3.79 | 9.07 | 50 |
| Q95J83 | Interleukin 7 | FLKRLLQKIKTCWNKIL | 0.76 | 5 | 3.79 | 9 | 51 |
| Q8HZN1 | Interleukin-7 | FLKRLLQKIKTCWNKIL | 0.76 | 5 | 3.79 | 9 | 52 |
| B6E124 | Interleukin-7 | FLKRLLQKIKTCWNKIL | 0.76 | 5 | 3.79 | 8.99 | 53 |
| A0A096N2Z5 | Uncharacterized protein | FLKRLLQKIKTCWNKIL | 0.76 | 5 | 3.79 | 9 | 54 |
| F7G6P7 | Uncharacterized protein (Fragment) | FLKRLLQKIKTCWNKIL | 0.76 | 5 | 3.79 | 8.81 | 55 |
| F7G6Q1 | Uncharacterized protein (Fragment) | FLKRLLQKIKTCWNKIL | 0.76 | 5 | 3.79 | 8.71 | 56 |

TABLE 4-continued

Priority alpha core peptide sequences

| Accession # | Name | Comp Form Match | HM | Q | HM*Q | PI | SEQ ID NO: |
|---|---|---|---|---|---|---|---|
| D0NCA0 | Putative uncharacterized protein | NGLFQKIKRWWKRIFDR | 0.75 | 5 | 3.73 | 10.62 | 57 |
| A0A093GP59 | Interferon alpha-2 (Fragment) | RRCLQLAHKVIRKL | 0.67 | 5.5 | 3.69 | 9.81 | 58 |
| H0Z3Q1 | Uncharacterized protein | FIKKLMTFIRKVLKT | 0.74 | 5 | 3.68 | 9.41 | 59 |
| L7NUA5 | Interleukin-7 variant 2 | FVKRLLDEIKTCWNKILRGAKK | 0.70 | 5 | 3.51 | 9.56 | 60 |
| L7NU76 | Interleukin-7 variant 5 | FVKRLLDEIKTCWNKILRGAKK | 0.70 | 5 | 3.51 | 9.48 | 61 |
| L7NU80 | Interleukin-7 variant 1 | FVKRLLDEIKTCWNKILRGAKK | 0.70 | 5 | 3.51 | 9.33 | 62 |
| L7NUC8 | Interleukin-7 variant 4 | FVKRLLDEIKTCWNKILRGAKK | 0.70 | 5 | 3.51 | 9.24 | 63 |
| L7NU82 | Interleukin-7 variant 3 | FVKRLLDEIKTCWNKILRGAKK | 0.70 | 5 | 3.51 | 9 | 64 |
| L7NU81 | Interleukin-7 variant 6 | FVKRLLDEIKTCWNKILRGAKK | 0.70 | 5 | 3.51 | 8.85 | 65 |
| H0VFS1 | Uncharacterized protein (Fragment) | FLKTLLQKIKTCWNKILRG | 0.68 | 5 | 3.40 | 9.27 | 66 |
| P48816 | Lysozyme (EC 3.2.1.17) (1,4-beta-N-acetylmuramidase) | ITKAAKCAKKIYKR | 0.56 | 6 | 3.37 | 9.06 | 67 |
| W2I7H3 | Uncharacterized protein | TQAWTNFKKWFKNWFKK | 0.67 | 5 | 3.36 | 8.34 | 68 |
| W2JZX5 | Uncharacterized protein | KEVIKKFTKAMEKMKK | 0.67 | 5 | 3.35 | 10.12 | 69 |
| W2VUY9 | Uncharacterized protein | KEVIKKFTKAMEKMKK | 0.67 | 5 | 3.35 | 10.12 | 70 |
| W2HTE6 | Uncharacterized protein | KEVIKKFTKAMEKMKK | 0.67 | 5 | 3.35 | 10.12 | 71 |
| A0A080Z0D6 | Uncharacterized protein | KEVIKKFTKAMEKMKK | 0.67 | 5 | 3.35 | 10.12 | 72 |
| W2FPC4 | Uncharacterized protein | KEVIKKFTKAMEKMKK | 0.67 | 5 | 3.35 | 9.91 | 73 |
| W2Y3P7 | Uncharacterized protein | KEVIKKFTKAMEKMKK | 0.67 | 5 | 3.35 | 9.91 | 74 |
| W2QT56 | Uncharacterized protein | KEVIKKFTKAMEKMKK | 0.67 | 5 | 3.35 | 9.91 | 75 |
| W2N8A5 | Uncharacterized protein | NGLFQKIKRWWKRIFEH | 0.74 | 4.5 | 3.34 | 10.43 | 76 |

TABLE 4-continued

Priority alpha core peptide sequences

| Accession # | Name | Comp Form Match | HM | Q | HM*Q | PI | SEQ ID NO: |
|---|---|---|---|---|---|---|---|
| W2RAE5 | Uncharacterized protein | NGLFQKIKRWWKRIFEH | 0.74 | 4.5 | 3.34 | 10.43 | 77 |
| W2WX61 | Uncharacterized protein | NGLFQKIKRWWKRIFEH | 0.74 | 4.5 | 3.34 | 10.43 | 78 |
| A0A081A496 | Uncharacterized protein | NGLFQKIKRWWKRIFEH | 0.74 | 4.5 | 3.34 | 10.31 | 79 |
| W2Z9T6 | Uncharacterized protein | NGLFQKIKRWWKRIFEH | 0.74 | 4.5 | 3.34 | 10.31 | 80 |
| P50718 | Lysozyme (EC 3.2.1.17) (1,4-beta-N-acetylmuramidase) | ITKASKCAKKIYKR | 0.55 | 6 | 3.33 | 9.15 | 81 |
| T0L7V9 | Uncharacterized protein | LWDKFQKFLKKVIRI | 0.82 | 4 | 3.30 | 6.88 | 82 |
| A0A072TQ32 | Transmembrane protein, putative | CNHMPNLLTRCLQRLKRLK | 0.60 | 5.5 | 3.28 | 10.05 | 83 |
| G7KJJ5 | Nodule Cysteine-Rich (NCR) secreted peptide | HSFYKCIDNLCKRFRR | 0.73 | 4.5 | 3.28 | 8.83 | 84 |
| A0A091WML3 | Interferon alpha-2 (Fragment) | MRRCLQLIDKVIRKL | 0.81 | 4 | 3.26 | 9.78 | 85 |
| A0A091K0Z9 | Interferon alpha-2 (Fragment) | MRRCLQLIDKVIRKL | 0.81 | 4 | 3.26 | 9.78 | 86 |
| A0A091JCY0 | Interferon epsilon (Fragment) | MRRCLQLIDKVIRKL | 0.81 | 4 | 3.26 | 9.76 | 87 |
| A0A091KMX5 | Interferon alpha-2 (Fragment) | MRRCLQLIDKVIRKL | 0.81 | 4 | 3.26 | 9.72 | 88 |
| A0A093RGB3 | Interferon alpha-2 (Fragment) | MRRCLQLIDKVIRKL | 0.81 | 4 | 3.26 | 9.63 | 89 |
| A0A091SY09 | Interferon alpha-2 (Fragment) | MRRCLQLIDKVIRKL | 0.81 | 4 | 3.26 | 9.62 | 90 |
| A0A094KQN9 | Interferon alpha-2 (Fragment) | MRRCLQLIDKVIRKL | 0.81 | 4 | 3.26 | 9.62 | 91 |
| A0A093L2W4 | Interferon alpha-2 (Fragment) | MRRCLQLIDKVIRKL | 0.81 | 4 | 3.26 | 9.6 | 92 |
| A0A093FC11 | Interferon alpha-2 (Fragment) | MRRCLQLIDKVIRKL | 0.81 | 4 | 3.26 | 9.55 | 93 |
| A0A087QSI7 | Interferon alpha-2 (Fragment) | MRRCLQLIDKVIRKL | 0.81 | 4 | 3.26 | 9.46 | 94 |

TABLE 4-continued

Priority alpha core peptide sequences

| Accession # | Name | Comp Form Match | HM | Q | HM*Q | PI | SEQ ID NO: |
|---|---|---|---|---|---|---|---|
| A0A087VKA8 | Interferon omega-1 (Fragment) | MRRCLQFIDKVIRKL | 0.81 | 4 | 3.26 | 9.57 | 95 |
| A0A091QVA3 | Interferon omega-1 (Fragment) | MRRCLQLIDKVIRKL | 0.81 | 4 | 3.26 | 9.65 | 96 |
| A0A091GAP8 | Interferon alpha-2 (Fragment) | MRRCLQLIEKVIRKL | 0.81 | 4 | 3.25 | 9.87 | 97 |
| A0A091L4R0 | Interleukin-21 (Fragment) | KEFLKSFEKLIKKVIR | 0.81 | 4 | 3.23 | 9.32 | 98 |
| A0A059BP64 | Uncharacterized protein | NLCKRACRTCCTHCRRVP | 0.59 | 5.5 | 3.22 | 8.61 | 99 |
| A0A091VJQ6 | Interferon alpha-2 (Fragment) | RRCLQLIDKVIRKL | 0.80 | 4 | 3.19 | 9.7 | 100 |
| A5JYR0 | Protein C06C3.10 | YARRFSTLFRHLIKMI | 0.71 | 4.5 | 3.18 | 11.56 | 101 |
| A0A091JU23 | Interleukin-21 (Fragment) | REFLKSFAKLIKKVI | 0.79 | 4 | 3.16 | 9.41 | 102 |
| A0A093IE23 | Interferon alpha-2 (Fragment) | MRRCLQLIDKVMRKL | 0.79 | 4 | 3.16 | 9.65 | 103 |
| A0A091P9G9 | Interferon alpha-2 (Fragment) | MRRCLQLIDKVVRKL | 0.79 | 4 | 3.16 | 9.76 | 104 |
| A0A091U5M0 | Interferon alpha-2 (Fragment) | MRRCLQLIDKAIRKI | 0.79 | 4 | 3.14 | 9.65 | 105 |
| A0A093BUH7 | Interferon epsilon (Fragment) | MRRCLQLIDKAIRKL | 0.78 | 4 | 3.11 | 9.33 | 106 |
| A0A094KTL8 | Interferon alpha-2 (Fragment) | MRRCLQLIDKAIKKL | 0.78 | 4 | 3.11 | 9.55 | 107 |
| A0A091SBM1 | Interferon beta (Fragment) | MRRCLQLVDKVIRKL | 0.78 | 4 | 3.11 | 9.61 | 108 |
| A0A093HSG6 | Interferon alpha-2 (Fragment) | MRRCLQFVDKVIKRL | 0.78 | 4 | 3.10 | 9.49 | 109 |
| A0A091HDU2 | Interferon alpha-2 (Fragment) | MRRCLQLVDKVIRKL | 0.78 | 4 | 3.10 | 9.72 | 110 |
| G1PT51 | Uncharacterized protein | VKKAVKYLRTIMKS | 0.62 | 5 | 3.10 | 9.96 | 111 |
| A0A091UC07 | Interleukin-21 (Fragment) | KEFLKSFAKLIKQVIR | 0.78 | 4 | 3.10 | 9.61 | 112 |
| A0A094K224 | Interleukin-21 (Fragment) | KEFLKSFAKLIKQVIR | 0.78 | 4 | 3.10 | 9.54 | 113 |
| A0A093IDB2 | Interleukin-21 (Fragment) | KEFLKSFAKLIKQVIR | 0.78 | 4 | 3.10 | 9.52 | 114 |

TABLE 4-continued

Priority alpha core peptide sequences

| Accession # | Name | Comp Form Match | HM | Q | HM*Q | PI | SEQ ID NO: |
|---|---|---|---|---|---|---|---|
| A0A091VRY9 | Interleukin-21 (Fragment) | KEFLKSFAKLIKQVIR | 0.78 | 4 | 3.10 | 9.46 | 115 |
| O95399 | Urotensin-2 (Urotensin II) (U-II) (UII) | LSHLLARIWKPYKK | 0.68 | 4.5 | 3.05 | 4.37 | 116 |
| M7W4U4 | Lecithin: cholesterol acyltransferase family protein (Fragment) | LSIFAKCFHDLIKKFKKLG | 0.68 | 4.5 | 3.04 | 4.45 | 117 |
| A0A091M384 | Interferon omega-1 (Fragment) | MRRCLQLIDKVARKL | 0.75 | 4 | 3.01 | 9.62 | 118 |
| Q8HYR8 | IL-7 | LLQKIKTCWNKILRGIKE | 0.75 | 4 | 3.01 | 9.04 | 119 |
| L8IFQ4 | Interleukin-7 (Fragment) | LLQKIKTCWNKILRGIKE | 0.75 | 4 | 3.01 | 9.02 | 120 |
| P26895 | Interleukin-7 (IL-7) | LLQKIKTCWNKILRGIKE | 0.75 | 4 | 3.01 | 9.02 | 121 |
| P01588 | Erythropoietin (Epoetin) | FRKLFRVYSNFLRG | 0.75 | 4 | 3.00 | 8.75 | 122 |
| Q91Y32 | Interleukin-7 | FLKRLLREIKTCWNKILNS | 0.74 | 4 | 2.98 | 8.75 | 123 |
| R0LJN1 | Interferon alpha-2 (Fragment) | IRRCLQLIDKAVRKLY | 0.74 | 4 | 2.97 | 9.5 | 124 |
| A0A044QPZ9 | Uncharacterized protein | NFLSLIKKIFSVWKR | 0.74 | 4 | 2.96 | 8.47 | 125 |
| F7BPI0 | Uncharacterized protein | KIMRKIMTNLSRLC | 0.74 | 4 | 2.95 | 10.06 | 126 |
| A0A093EX75 | Interleukin-21 | KEFLKSFAKLIQKVIKS | 0.72 | 4 | 2.90 | 9.28 | 127 |
| A0A091E7E9 | Interleukin-5 (Fragment) | FIKKLMTFIQKVLKN | 0.72 | 4 | 2.88 | 9.13 | 128 |
| P0DKN3 | Turripeptide Lol11.2 (OL67) | RDAGRLLRSLKKLK | 0.57 | 5 | 2.87 | 8.7 | 129 |
| A0A091LVZ3 | Uncharacterized protein | KNATTFIKKLMTFIRKA | 0.57 | 5 | 2.84 | 9.2 | 130 |
| S9YX13 | Olfactory receptor 4A15 | GEMKNAMKKLWTRVRK | 0.57 | 5 | 2.83 | 9.46 | 131 |
| V9DV74 | Uncharacterized protein | TQAWTNFKKWFKKWFKE | 0.69 | 4 | 2.74 | 8.34 | 132 |
| W2KE58 | Uncharacterized protein | TQAWTNFKKWFKKWFKE | 0.69 | 4 | 2.74 | 8.34 | 133 |
| L8YAP6 | Interleukin-13 | EVAQFVKDLLRHLKRLYRH | 0.68 | 4 | 2.73 | 8.97 | 134 |
| Q6UXQ8 | Putative uncharacterized protein UNQ6190/PRO20217 | GAGRKVCAKLVKRL | 0.55 | 5 | 2.73 | 11.8 | 135 |

TABLE 4-continued

Priority alpha core peptide sequences

| Accession # | Name | Comp Form Match | HM | Q | HM*Q | PI | SEQ ID NO: |
|---|---|---|---|---|---|---|---|
| U6CRU1 | Interleukin-7 | LLQKIKTCWNKILRGS | 0.68 | 4 | 2.71 | 9.03 | 136 |
| D2HR10 | Putative uncharacterized protein (Fragment) | LLQKIKTCWNKILRGS | 0.68 | 4 | 2.71 | 9.7 | 137 |
| M3W2P1 | Uncharacterized protein | LLQKIKTCWNKILRGS | 0.68 | 4 | 2.71 | 9.15 | 138 |
| M4CA57 | Uncharacterized protein | NFIKRINDFLKKAKS | 0.67 | 4 | 2.69 | 9.89 | 139 |
| P13725 | Oncostatin-M (OSM) | RFLHGYHRFMHSVGRVFSKWGES | 0.60 | 4.5 | 2.69 | 10.6 | 140 |
| U5TZM0 | Interleukin-7 | LLQKIKTCWNKILRGAKEY | 0.67 | 4 | 2.68 | 8.85 | 141 |
| Q9N2G6 | Interleukin-7 (IL-7) | LLQKIKTCWNKILRGAKEY | 0.67 | 4 | 2.68 | 8.7 | 142 |
| K7GL89 | Uncharacterized protein | LLQKIKTCWNKILRGAKEY | 0.67 | 4 | 2.68 | 7.77 | 143 |
| K7GL01 | Uncharacterized protein (Fragment) | LLQKIKTCWNKILRGAKEY | 0.67 | 4 | 2.68 | 7.74 | 144 |
| A0A093PT39 | Interleukin-5 (Fragment) | FINKLMTFIRKALKP | 0.66 | 4 | 2.65 | 9.3 | 145 |
| Q91ZL2 | Interleukin 4 | LKDFLKSLKRIM | 0.88 | 3 | 2.64 | 9.27 | 146 |
| P81278 | Prolactin-releasing peptide (PrRP) (Prolactin-releasing hormone) [Cleaved into: Prolactin-releasing peptide PrRP31; Prolactin-releasing peptide PrRP20] | GRGIRPVGRFGRR | 0.53 | 5 | 2.63 | 11.42 | 147 |
| A0A080YYV3 | Uncharacterized protein | NGLWQRFLRWWNRLFH | 0.75 | 3.5 | 2.62 | 9.86 | 148 |
| W2VQZ9 | Uncharacterized protein | NGLWQRFLRWWNRLFH | 0.75 | 3.5 | 2.62 | 9.86 | 149 |
| W2PXT4 | Uncharacterized protein | NGLWQRFLRWWNRLFH | 0.75 | 3.5 | 2.62 | 9.69 | 150 |
| P86442 | Neuropeptide F (Lom-NPF) (NPF) (longNPF) | SADKFWRRFARR | 0.66 | 4 | 2.62 | 10.84 | 151 |
| B8BP19 | Putative uncharacterized protein | WSRWWSSCWRLWTRIY | 0.87 | 3 | 2.61 | 4.85 | 152 |
| W2ZYU4 | Uncharacterized protein | YLKEALSRFKSWLKR | 0.65 | 4 | 2.60 | 10.07 | 153 |

TABLE 4-continued

Priority alpha core peptide sequences

| Accession # | Name | Comp Form Match | HM | Q | HM*Q | PI | SEQ ID NO: |
|---|---|---|---|---|---|---|---|
| Q9XTN0 | Peptidoglycan recognition protein | SPGRKLYNQIRRWP | 0.65 | 4 | 2.59 | 6.71 | 154 |
| X6P0L4 | Uncharacterized protein | KYGKSCEKAVHDLWHIIKKF | 0.64 | 4 | 2.58 | 8.2 | 155 |
| P24355 | 50S ribosomal protein L36, plastid | KVYSSVRKICKSCG | 0.64 | 4 | 2.57 | 11.06 | 156 |
| W2YJS0 | Uncharacterized protein | TQAWTNFKKWFKKMV | 0.64 | 4 | 2.55 | 5.08 | 157 |
| Q9BBQ2 | 50S ribosomal protein L36, chloroplastic | KIGASVRKICEKCR | 0.64 | 4 | 2.55 | 11.79 | 158 |
| W2HIB3 | Uncharacterized protein | GGGRDVLTRFKSWFKRVFGK | 0.50 | 5 | 2.52 | 8.39 | 159 |
| P50717 | Lysozyme (EC 3.2.1.17) (1,4-beta-N-acetylmuramidase) | ITKASTCAKKIFKR | 0.50 | 5 | 2.52 | 8.92 | 160 |
| A0A094LD69 | Uncharacterized protein (Fragment) | FIEKLMTFIRKALKNAR | 0.63 | 4 | 2.51 | 9.3 | 161 |
| Q6UXT8 | Protein FAM150A | AYYKRCARLLTRLA | 0.63 | 4 | 2.51 | 10.39 | 162 |
| Q4RU86 | Protein FAM150-like | AYYKRCARLLTRLA | 0.63 | 4 | 2.51 | 9.98 | 163 |
| I7GA36 | Macaca fascicularis brain cDNA clone: QtrA-18967, similar to human HSPC039 protein (HSPC039), mRNA, RefSeq: NM_016097.2 | SQLRNLIRSVRTVMR | 0.62 | 4 | 2.49 | 8.59 | 164 |
| A0A093IPB5 | Interleukin-5 (Fragment) | KNATKFIEKLMTFIRRA | 0.62 | 4 | 2.48 | 9.2 | 165 |
| P81277 | Prolactin-releasing peptide (PrRP) (Prolactin-releasing hormone) [Cleaved into: Prolactin-releasing | YASRGIRPVGRFGRR | 0.49 | 5 | 2.45 | 11.6 | 166 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | peptide PrRP31; Prolactin-releasing peptide PrRP20] | | | | | | |
| P01574 | Interferon beta (IFN-beta) (Fibroblast interferon) | HLKRYYGRILHYLKA | 0.49 | 5 | 2.45 | 8.9 | 167 |
| Q80UG6 | Protein FAM150B | TIPAYYKRCARLLTRLA | 0.61 | 4 | 2.44 | 9.57 | 168 |
| B2RZ42 | Protein FAM150B | TIPAYYKRCARLLTRLA | 0.61 | 4 | 2.44 | 9.57 | 169 |
| Q6UX46 | Protein FAM150B | TIPAYYKRCARLLTRLA | 0.61 | 4 | 2.44 | 9.37 | 170 |
| P55897 | Histone H2A [Cleaved into: Buforin-1 (Buforin I); Buforin-2 (Buforin II)] (Fragment) | VGRVHRLLRKGN | 0.54 | 4.5 | 2.43 | 12.41 | 171 |
| P07815 | 50S ribosomal protein L36, chloroplastic | KVAASVRKICEKCR | 0.61 | 4 | 2.42 | 11.64 | 172 |
| Q95PE0 | Putative uncharacterized protein (Fragment) | IRKIAQLLNKVADAAKKG | 0.60 | 4 | 2.41 | 4.94 | 173 |
| Q2V364 | Putative defensin-like protein 23 | GGFCKRFAGGAKKCH | 0.54 | 4.5 | 2.41 | 9.14 | 174 |
| Q3E7A6 | Uncharacterized protein YML007C-A, mitochondrial | MRFMRRLVRNLQY | 0.60 | 4 | 2.40 | 12.18 | 175 |
| P04567 | Mast cell degranulating peptide (MCD peptide) (MCDP) | LPGFIGKICRKI | 0.80 | 3 | 2.39 | 9.5 | 176 |
| Q3E821 | Uncharacterized protein YBL008W-A | ILANIHKIIKAYQR | 0.68 | 3.5 | 2.38 | 11.19 | 177 |
| K4A4B8 | Uncharacterized protein | IFHGCKKVARVL | 0.68 | 3.5 | 2.37 | 9.19 | 178 |
| P01210 | Proenkephalin-A [Cleaved into: Synenkephalin; | LAKRYGGFMKRYGGFMKKMDELY | 0.58 | 4 | 2.34 | 5.3 | 179 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | Met-enkephalin (Opioid growth factor) (OGF); PENK(114-133); PENK(143-183); Met-enkephalin-Arg-Gly-Leu; Leu-enkephalin; PENK(237-258); Met-enkephalin-Arg-Phe] | | | | | | |
| A0A085MM52 | Uncharacterized protein | QAIRCMQSLFRTVKR | 0.58 | 4 | 2.33 | 9.45 | 180 |
| Q8N729 | Neuropeptide W (Preproprotein L8) (hPPL8) [Cleaved into: Neuropeptide W-23 (NPW23) (hL8); Neuropeptide W-30 (NPW30) (hL8C)] | WRRALRAAAGPLAR | 0.58 | 4 | 2.33 | 11.4 | 181 |
| R0MAQ4 | NUDIX hydrolase | IKRIIRDVKEIVRA | 0.77 | 3 | 2.32 | 6.92 | 182 |
| A0A093C1K6 | Interleukin-21 (Fragment) | KEFLKSFEKLIQKVIR | 0.77 | 3 | 2.32 | 9.21 | 183 |
| R0M641 | Uncharacterized protein | EKVSNWWKRIWEKIKN | 0.77 | 3 | 2.31 | 5.8 | 184 |
| R0M5R6 | Uncharacterized protein | EKVSNWWKRIWEKIKN | 0.77 | 3 | 2.31 | 5.8 | 185 |
| M4BXP7 | Uncharacterized protein | IPSCVTRALSRAARSIWDALKKI | 0.58 | 4 | 2.31 | 9.89 | 186 |
| Q9NRR1 | Cytokine-like protein 1 (Protein C17) | ARKLYTIMNSFCRR | 0.58 | 4 | 2.31 | 8.22 | 187 |
| P81447 | Glycosylation-dependent cell adhesion molecule 1 (GlyCAM-1) (28 kDa milk glycoprotein PP3) (Lactophorin) (Proteose-peptone component 3) (PP3) | GKLMELGHKIMKNLENTVKEIIKYLKSLF | 0.66 | 3.5 | 2.29 | 5.13 | 188 |
| K7GRI1 | Interleukin | KPIKEFLERLKSLIQKMIHQ | 0.65 | 3.5 | 2.27 | 9.39 | 189 |

TABLE 4-continued

Priority alpha core peptide sequences

| Accession # | Name | Comp Form Match | HM | Q | HM*Q | PI | SEQ ID NO: |
|---|---|---|---|---|---|---|---|
| F1RQN2 | Interleukin | KPIKEFLERLKSLIQKMIHQ | 0.65 | 3.5 | 2.27 | 9.39 | 190 |
| Q76LU6 | Interleukin-21 (IL-21) | KPIKEFLERLKSLIQKMIHQ | 0.65 | 3.5 | 2.27 | 9.25 | 191 |
| A0A093G4B0 | Interleukin-21 (Fragment) | KEFLKSFAKLIQKVI | 0.76 | 3 | 2.27 | 9.49 | 192 |
| A0A091LQM6 | Interleukin-21 (Fragment) | KEFLKSFAKLIQKVI | 0.76 | 3 | 2.27 | 9.22 | 193 |
| Q09GK2 | C-type natriuretic peptide (CNP) | RRLKGVAKKGLG | 0.45 | 5 | 2.27 | 8.9 | 194 |
| H2QWB6 | Interleukin 7 (Uncharacterized protein) | FLKRLLQEIKTCWNKIL | 0.75 | 3 | 2.26 | 8.72 | 195 |
| P13232 | Interleukin-7 (IL-7) | FLKRLLQEIKTCWNKIL | 0.75 | 3 | 2.26 | 8.72 | 196 |
| Q5FBX5 | IL7 nirs variant 1 (Interleukin-7) | FLKRLLQEIKTCWNKIL | 0.75 | 3 | 2.26 | 6.14 | 197 |
| A8K673 | cDNAFLJ75417, highly similar to *Homo sapiens* interleukin 7, mRNA | FLKRLLQEIKTCWNKIL | 0.75 | 3 | 2.26 | 8.72 | 198 |
| H2PQM2 | Uncharacterized protein | FLKRLLQEIKTCWNKIL | 0.75 | 3 | 2.26 | 8.72 | 199 |
| G1QNL2 | Uncharacterized protein | FLKRLLQEIKTCWNKIL | 0.75 | 3 | 2.26 | 8.72 | 200 |
| G3QDY6 | Uncharacterized protein | FLKRLLQEIKTCWNKIL | 0.75 | 3 | 2.26 | 7.75 | 201 |
| F6TDR4 | Interleukin | KPLKEFLERLKSLIQKMIHQ | 0.64 | 3.5 | 2.26 | 9.66 | 202 |
| A0A093EHY0 | Interleukin-21 (Fragment) | KEFLKSFANLIKQVIR | 0.75 | 3 | 2.26 | 9.1 | 203 |
| L8I6N0 | Glycosylation-dependent cell adhesion molecule 1 | GKLMELGHKIMRNLENTVKETIKYLKSLFSHASEWK | 0.56 | 4 | 2.25 | 5.98 | 204 |
| G3KFL3 | PexRD2 | HKMKKLLRYLNY | 0.50 | 4.5 | 2.24 | 9.52 | 205 |
| Q0ZCA0 | Putative accessory gland protein (Fragment) | KSFSSICKELCKLCQRC | 0.75 | 3 | 2.24 | 8.7 | 206 |
| Q0ZC97 | Putative accessory gland | KSFSSICKELCKLCQRC | 0.75 | 3 | 2.24 | 8.64 | 207 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | protein (Fragment) | | | | | | |
| A0A091H9P3 | Interleukin-21 (Fragment) | KEFLQSFGKLINKVIR | 0.74 | 3 | 2.23 | 9.49 | 208 |
| A0A091V0J9 | Myelomonocytic growth factor (Fragment) | ILANFQRFLETAYRALRHLAR | 0.64 | 3.5 | 2.22 | 5.67 | 209 |
| A0A091J8M6 | Interleukin-21 (Fragment) | KEFLKSFAKLIQQVIR | 0.74 | 3 | 2.22 | 9.54 | 210 |
| A0A091K4W3 | Interleukin-21 (Fragment) | KEFLKSFAKLIQQVIR | 0.74 | 3 | 2.22 | 9.39 | 211 |
| A0A093PBX6 | Interleukin-21 (Fragment) | KEFLKSFAKLIQQVIR | 0.74 | 3 | 2.22 | 9.34 | 212 |
| A0A091SVN6 | Interleukin-21 (Fragment) | KEFLKSFAKLIQQVIR | 0.74 | 3 | 2.22 | 9.32 | 213 |
| U3IH11 | Interleukin | KEFLQSFSKLMKKV | 0.74 | 3 | 2.22 | 9.37 | 214 |
| A0A078J1N0 | BnaC02g44190D protein | KPLHTMVNHISRFATKMT | 0.55 | 4 | 2.21 | 4.97 | 215 |
| B3NKZ6 | Protein Turandot E (Protein Victoria) | GGKLFDVLKKIIKVI | 0.74 | 3 | 2.21 | 9.62 | 216 |
| A0A087VKZ4 | Interleukin-21 (Fragment) | KEFLQSFAKLIKQVIR | 0.73 | 3 | 2.19 | 9.34 | 217 |
| Q28540 | Interleukin-7 (IL-7) | LLQKIKTCWNKILRGITE | 0.73 | 3 | 2.19 | 8.89 | 218 |
| B9HA59 | Uncharacterized protein | RIRDVFSSIFRNIFNLFR | 0.73 | 3 | 2.19 | 10.7 | 219 |
| B6E474 | 8 kDa glycoprotein | QKIAQLVKKWIKTVLEAR | 0.54 | 4 | 2.17 | 9.78 | 220 |
| P80195 | Glycosylation-dependent cell adhesion molecule 1 (GlyCAM-1) (28 kDa milk glycoprotein PP3) (Lactophorin) (Proteose-peptone component 3) (PP3) | GKLMELGHKIMRNLENTVK ETIKYL KSLFSHAFEVVKT | 0.54 | 4 | 2.15 | 5.98 | 221 |
| S7MSM8 | Interleukin-13 | EVTRLAKDLLQQLRKGVRQGK | 0.54 | 4 | 2.15 | 9.4 | 222 |
| L5M5Z7 | Interleukin-13 | EVTRLAKDLLQQLRKGVRQGK | 0.54 | 4 | 2.15 | 9.1 | 223 |
| P0CY42 | ATP synthase protein 8 (A6L) | LPRLLRTYISRI | 0.71 | 3 | 2.14 | 10.28 | 224 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | (F-ATPase subunit 8) | | | | | | |
| P0CY41 | ATP synthase protein 8 (A6L) (F-ATPase subunit 8) | LPRLLRTYISRI | 0.71 | 3 | 2.14 | 10.28 | 225 |
| K0KI76 | Putative secreted protein | LKKLNQIVQKFHQLLQG | 0.61 | 3.5 | 2.14 | 4.85 | 226 |
| T1PF69 | Dynein heavy chain and region D6 of dynein motor | DFKNLIRKCVDVARKV | 0.71 | 3 | 2.14 | 8.71 | 227 |
| W2HGG0 | Uncharacterized protein | NATTYLKEALSRFKSWLKR | 0.53 | 4 | 2.13 | 10.07 | 228 |
| V9FSC7 | Uncharacterized protein | NATTYLKEALSRFKSWLKR | 0.53 | 4 | 2.13 | 10.07 | 229 |
| A0A081AW62 | Uncharacterized protein | NATTYLKEALSRFKSWLKR | 0.53 | 4 | 2.13 | 9.98 | 230 |
| P36925 | Interleukin-8 (IL-8) (C-X-C motif chemokine 8) (Chemokine (C-X-C motif) ligand 8) | KWVQKVVQAFLKRAEK | 0.53 | 4 | 2.12 | 9.03 | 231 |
| K7FKJ3 | Uncharacterized protein | ARKMVTRALRALQN | 0.53 | 4 | 2.12 | 8.24 | 232 |
| F7I3A3 | Interleukin | KEFLERFKSLLQKMIHR | 0.60 | 3.5 | 2.11 | 9.25 | 233 |
| Q9TJR5 | 50S ribosomal protein L32, plastid | AKKALAKAKTVLK | 0.42 | 5 | 2.10 | 11.45 | 234 |
| W2IIM7 | Uncharacterized protein | NGLWQRFLRWWNRLFTG | 0.70 | 3 | 2.10 | 10.1 | 235 |
| W2VQV4 | Uncharacterized protein | NGLWQRFLRWWNRLFTG | 0.70 | 3 | 2.10 | 10.1 | 236 |
| V9EMI9 | Uncharacterized protein | NGLWQRFLRWWNRLFTG | 0.70 | 3 | 2.10 | 10.1 | 237 |
| D0N532 | Putative uncharacterized protein | ATKLSDAMQRIKTMFRNWYQK | 0.52 | 4 | 2.09 | 10.19 | 238 |
| P46690 | Gibberellin-regulated | CITFCNKCCRKCL | 0.70 | 3 | 2.09 | 9.42 | 239 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | protein 4 (GAST1 protein *homolog* 4) | | | | | | |
| C5YGU9 | Putative uncharacterized protein Sb07g003410 | CCDLIRKCWHDIKECWKRC | 0.83 | 2.5 | 2.08 | 9.02 | 240 |
| Q9GKA2 | Erythropoietin | KLFRIYSNFLRG | 0.69 | 3 | 2.08 | 8.89 | 241 |
| Q6H8T1 | Erythropoietin | KLFRIYSNFLRG | 0.69 | 3 | 2.08 | 8.74 | 242 |
| Q6H8S9 | Erythropoietin | KLFRIYSNFLRG | 0.69 | 3 | 2.08 | 8.74 | 243 |
| Q6H8T0 | Erythropoietin | KLFRIYSNFLRG | 0.69 | 3 | 2.08 | 8.74 | 244 |
| P33708 | Erythropoietin | KLFRIYSNFLRG | 0.69 | 3 | 2.08 | 8.68 | 245 |
| Q6H8T2 | Erythropoietin | KLFRIYSNFLRG | 0.69 | 3 | 2.08 | 8.42 | 246 |
| Q867B1 | Erythropoietin | KLFRIYSNFLRG | 0.69 | 3 | 2.08 | 8.35 | 247 |
| D7KU31 | Putative uncharacterized protein | EKFESCMKKCSKICNK | 0.69 | 3 | 2.08 | 6.62 | 248 |
| Q0Z956 | Erythropoietin | KLFRVYSNFLRG | 0.69 | 3 | 2.08 | 9.03 | 249 |
| P29676 | Erythropoietin | KLFRVYSNFLRG | 0.69 | 3 | 2.08 | 8.73 | 250 |
| Q28513 | Erythropoietin | KLFRVYSNFLRG | 0.69 | 3 | 2.08 | 8.35 | 251 |
| P07865 | Erythropoietin | KLFRVYSNFLRG | 0.69 | 3 | 2.08 | 8.35 | 252 |
| P38215 | Putative uncharacterized protein YBR013C | RKLYHRVGTCIQNIF | 0.59 | 3.5 | 2.07 | 6.07 | 253 |
| P06759 | Apolipoprotein C-III (Apo-CIII) (ApoC-III) (Apolipoprotein C3) | FKSLKGYWSKFT | 0.69 | 3 | 2.07 | 4.36 | 254 |
| B1GVZ6 | Interleukin 7 | ISSLRSCWNKFEKIISR | 0.69 | 3 | 2.06 | 8.91 | 255 |
| A8MRM1 | Protein RALF-like 16 | VNHYHRGCEKITRCARDAARY | 0.51 | 4 | 2.06 | 8.45 | 256 |
| U3K1R5 | Uncharacterized protein | ISSLRSCWNKFEKLISR | 0.69 | 3 | 2.06 | 8.91 | 257 |
| R4WCP1 | Cysteine rich secreted protein | CCRKVVKYWTHCCQEGLRCT | 0.59 | 3.5 | 2.06 | 8.72 | 258 |
| C1MNQ9 | Predicted protein | GRTFRSCARTAFRTAKL | 0.41 | 5 | 2.05 | 6.79 | 259 |
| P07321 | Erythropoietin | KLFRVYANFLRG | 0.68 | 3 | 2.05 | 7.87 | 260 |
| A0A061DMT2 | Uncharacterized protein | YGRGCRRCCSYL | 0.68 | 3 | 2.05 | 7.78 | 261 |
| F6PXB2 | Uncharacterized protein | FLKRLLQEIKTCWNKILSG | 0.68 | 3 | 2.03 | 8.71 | 262 |

TABLE 4-continued

Priority alpha core peptide sequences

| Accession # | Name | Comp Form Match | HM | Q | HM*Q | PI | SEQ ID NO: |
|---|---|---|---|---|---|---|---|
| F6PXS2 | Uncharacterized protein (Fragment) | FLKRLLQEIKTCWNKILSG | 0.68 | 3 | 2.03 | 6.91 | 263 |
| F6PXG8 | Uncharacterized protein (Fragment) | FLKRLLQEIKTCWNKILSG | 0.68 | 3 | 2.03 | 5.68 | 264 |
| A0A094ICS8 | Uncharacterized protein | SVARHAARDLRRWM | 0.58 | 3.5 | 2.01 | 9.67 | 265 |
| F6U832 | Uncharacterized protein | LLQKIKTCWNKILRDAKE | 0.67 | 3 | 2.01 | 8.7 | 266 |
| P09641 | Peptide YY-like (PYY) | WAKYHAAVRHYVNLITR | 0.50 | 4 | 2.01 | 8.39 | 267 |
| P81028 | Peptide YY-like (PYY) | WAKYHAAVRHYVNLITR | 0.50 | 4 | 2.01 | 8.35 | 268 |
| G3VIZ8 | Uncharacterized protein | EEVFKKFKKVAKSFG | 0.67 | 3 | 2.01 | 7.83 | 269 |
| O61466 | FMRFamide-like neuropeptides 5 [Cleaved into: APKPKFIRF-amide; AGAKFIRF-amide; GAKFIRF-amide] | FGRAGAKFIRFGRS | 0.50 | 4 | 2.00 | 11.17 | 270 |
| C4V9A1 | Putative uncharacterized protein | DLKTLFTTIWKFIKK | 0.67 | 3 | 2.00 | 6.31 | 271 |
| P86730 | Perlwapin (Fragment) | KKCCGGCPRLCEK | 0.67 | 3 | 2.00 | 8.45 | 272 |
| A8MQM7 | Protein RALF-like 15 | KQVANPYRRGCGTIERCR | 0.49 | 4 | 1.97 | 9.96 | 273 |
| H3FNG9 | Uncharacterized protein | SDAKKLMRDLKRML | 0.66 | 3 | 1.97 | 5.38 | 274 |
| Q29614 | Beta-lactoglobulin (Beta-LG) | NKGMNEFKKILRTLA | 0.65 | 3 | 1.95 | 5.56 | 275 |
| Q7M747 | Secretoglobin family 2B member 24 (Allergen dI chain C2B) (Androgen-binding protein zeta) (Lacrimal androgen-binding protein zeta) | FTKIKDALKKISQ | 0.65 | 3 | 1.95 | 6.11 | 276 |
| P15457 | 2S seed storage protein 1 | VRKIYQTAKHLP | 0.56 | 3.5 | 1.95 | 10.44 | 277 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | (2S albumin storage protein) (NWMU2-2S albumin 1) [Cleaved into: 2S seed storage protein 1 small subunit; 2S seed storage protein 1 large subunit] | | | | | | |
| Q0V822 | Protein RALF-like 26 | VHNYSRGCSRITRCR | 0.43 | 4.5 | 1.95 | 11.19 | 278 |
| J9P346 | Uncharacterized protein | KIKRIVQKILESAER | 0.65 | 3 | 1.95 | 8.73 | 279 |
| P49164 | 50S ribosomal protein L34, chloroplastic | ARMATKLGRKVLN | 0.48 | 4 | 1.93 | 12.23 | 280 |
| A5WYF5 | Putative 4.8 kDa secreted salivary gland protein | KTLVNLWSKLAQRIF | 0.64 | 3 | 1.93 | 4.53 | 281 |
| Q9GZZ8 | Extracellular glycoprotein lacritin | QALAKAGKGMHGGVPGGKQ FIENGS EFAQKLLKKF | 0.43 | 4.5 | 1.93 | 5.17 | 282 |
| Q9FZA0 | Protein RALF-like 4 | NPYRRGCSAITHCYRYAR | 0.43 | 4.5 | 1.92 | 10.76 | 283 |
| K9JHY4 | Leptin | RVKQVLNQLLKNMDHLK | 0.55 | 3.5 | 1.92 | 9.15 | 284 |
| A0A076YJS8 | Interleukin 4/13-3 | VSSFLEHVKRCVRH | 0.63 | 3 | 1.90 | 8.59 | 285 |
| A0A023G9C2 | Putative secreted protein | LRTVTELLKKVVDAAKK | 0.63 | 3 | 1.90 | 5.02 | 286 |
| B4G535 | Protein Turandot Z | AKALFNKLTEYLKK | 0.63 | 3 | 1.90 | 5.25 | 287 |
| B1MTQ2 | Interleukin 13 (Predicted) | EVAQFVKDLLRHLRKLFHQ G | 0.63 | 3 | 1.89 | 9.02 | 288 |
| B0KWP3 | Interleukin 13 | EVAQFVKDLLRHLRKLFHQ G | 0.63 | 3 | 1.89 | 8.78 | 289 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | (Interleukin 13 (Predicted)) | | | | | | |
| F7H944 | Uncharacterized protein (Fragment) | EVAQFVKDLLRHLRKLFHQG | 0.63 | 3 | 1.89 | 8.69 | 290 |
| E9Q6L3 | Methylglutaconyl-CoA hydratase, mitochondrial | KNLLKMLSKAVDALKS | 0.62 | 3 | 1.87 | 9.72 | 291 |
| Q9P0W0 | Interferon kappa (IFN-kappa) | LRRYFHRIDNFLKE | 0.74 | 2.5 | 1.86 | 8.8 | 292 |
| O82377 | EMBRYO SURROUNDING FACTOR 1-like protein 6 | SRCYRSLYKCVA | 0.62 | 3 | 1.85 | 8.9 | 293 |
| G3V2A7 | Type II iodothyronine deiodinase | QWLTSCWSTLMRLIHQMAGRYR | 0.53 | 3.5 | 1.84 | 10.86 | 294 |
| P48131 | 50S ribosomal protein L36, cyanelle | ASVRKMCEKCRTIR | 0.46 | 4 | 1.84 | 11.64 | 295 |
| Q43194 | Non-specific lipid-transfer protein 2 (LTP 2) | CLKNAARGIRGLN | 0.61 | 3 | 1.83 | 9.45 | 296 |
| Q0IQK9 | Non-specific lipid-transfer protein 1 (LTP 1) (PAPI) | CLKNAARGIKGLN | 0.61 | 3 | 1.83 | 9.41 | 297 |
| B5FW67 | Interleukin 13 (Predicted) (Uncharacterized protein) | EVAQFIKDLLRHLKK | 0.72 | 2.5 | 1.81 | 9.42 | 298 |
| P58784 | Trp-Contryphan-P | GGAIGKFMNVLRR | 0.60 | 3 | 1.79 | 3.8 | 299 |
| O65919 | Protein RALF-like 10 | ANEYRRGCSKITRCK | 0.45 | 4 | 1.79 | 9.69 | 300 |
| P0C0P7 | Neuropeptide S | RSFRNGVGSGVKK | 0.45 | 4 | 1.78 | 12.31 | 301 |
| G2TRK4 | Uncharacterized protein C1399.06 | TILRKARNLLNHGI | 0.51 | 3.5 | 1.78 | 10.3 | 302 |
| P86941 | Insulinotropic peptide 1 (FSIP) | AVWKDFLKNIGKAAGKAV | 0.59 | 3 | 1.78 | 8.47 | 303 |

TABLE 4-continued

Priority alpha core peptide sequences

| Accession # | Name | Comp Form Match | HM | Q | HM*Q | PI | SEQ ID NO: |
|---|---|---|---|---|---|---|---|
| B4MKX9 | GK17255 | KHAHSMITSMLSFVNSVVNFGRSFVRN | 0.44 | 4 | 1.78 | 8.14 | 304 |
| A0A016W2T3 | Uncharacterized protein | VKKMLKDVPKLATS | 0.59 | 3 | 1.78 | 8.28 | 305 |
| Q5UW37 | VEGF coregulated chemokine 1 (13.6 kDa protein) (C-X-C motif chemokine 17) | RACQQFLKRCHL | 0.51 | 3.5 | 1.77 | 10.37 | 306 |
| Q9GLK4 | Natriuretic peptides B (Gamma-brain natriuretic peptide) [Cleaved into: Brain natriuretic peptide 32 (BNP-32)] | NVLRALRRLGSS | 0.59 | 3 | 1.77 | 7.09 | 307 |
| A0A074ZW10 | Uncharacterized protein | GKNWSEFVRSMLRAMSKVAA | 0.59 | 3 | 1.77 | 5.07 | 308 |
| G3T2N9 | Uncharacterized protein | ELITFMKNLLDHLRRIYR | 0.71 | 2.5 | 1.76 | 9.23 | 309 |
| Q2XPU9 | Vdg3 | ICKSFQSLVHRFGHVT | 0.58 | 3 | 1.75 | 5.32 | 310 |
| P22298 | Antileukoproteinase (ALP) (Secretory leukocyte protease inhibitor) (Fragment) | LKCCKSMCGKVC | 0.58 | 3 | 1.75 | 9.11 | 311 |
| O77234 | SPO-1 protein (Stage-specific protein SPO-1) (Stathmin-like protein) | KRMEYIAKKLDK | 0.58 | 3 | 1.74 | 8.92 | 312 |
| H2MKX6 | Uncharacterized protein | ASWQQIFQRIIRVLRS | 0.58 | 3 | 1.73 | 11.83 | 313 |
| P15696 | Interferon tan-1 (IFN-tau-1) (Antiluteolysin) (Trophoblast antiluteolytic protein) (Trophoblast protein 1) (TP-1) (Trophoblastin) | KRLRKMGGDLNSL | 0.58 | 3 | 1.73 | 5.74 | 314 |
| M4WK63 | Cul o 5 allergen | KSYVEKLTKALSTIRQCI | 0.57 | 3 | 1.72 | 9.23 | 315 |

TABLE 4-continued

Priority alpha core peptide sequences

| Accession # | Name | Comp Form Match | HM | Q | HM*Q | PI | SEQ ID NO: |
|---|---|---|---|---|---|---|---|
| A8CL69 | PBAN-type neuropeptides (Pheromone/pyrokinin biosynthesis-activating neuropeptide) [Cleaved into: TSQDITSGMWFGPRL-amide (Pyrokinin-1); QITQFTPRL-amide (Pyrokinin-2); IYLPLFASRL-amide; VPWTPSPRL-amide] | RLGRQLHNIVDK | 0.69 | 2.5 | 1.72 | 5.5 | 316 |
| F6R9B2 | Uncharacterized protein (Fragment) | SQLTNLIRSVRTVMR | 0.57 | 3 | 1.71 | 8.95 | 317 |
| Q3SYR5 | Apolipoprotein C-IV (Apo-CIV) (ApoC-IV) (Apolipoprotein C4) | LKDLGSRARAWLRS | 0.57 | 3 | 1.71 | 9.07 | 318 |
| P0C0P5 | Neuropeptide S | RSFRNGVGTGMKK | 0.43 | 4 | 1.71 | 12.31 | 319 |
| P0C0P6 | Neuropeptide S | RSFRNGVGTGMKK | 0.43 | 4 | 1.71 | 12.02 | 320 |
| Q6NME6 | Protein RALF-like 19 | YRRGCSVITHCYRQ | 0.49 | 3.5 | 1.71 | 10.75 | 321 |
| P07597 | Non-specific lipid-transfer protein 1 (LTP 1) (Probable amylase/protease inhibitor) | CLKGIARGIHNLN | 0.68 | 2.5 | 1.70 | 8.19 | 322 |
| Q9WVA9 | Pro-FMRFamide-related neuropeptide FF (FMRFamide-related peptides) [Cleaved into: Neuropeptide SF (NPSF); Neuropeptide FF (NPFF); Neuropeptide AF-like (NPAF)] | RFGRNAWGPWSK | 0.56 | 3 | 1.69 | 9.75 | 323 |
| Q9SRY3 | Protein RALF-like 1 (Rapid alkalinization factor | ANPYSRGCSKIARCR | 0.42 | 4 | 1.69 | 10.06 | 324 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | 1) (AtRALF1) | | | | | | |
| A0A024GHZ6 | Albugo candida WGS project CAIX00000000 data, strain Ac Nc2, contig AcNc2 CONTIG 128 length 64418 | ILHSFLKVLHHL | 0.67 | 2.5 | 1.69 | 9.18 | 325 |
| Q91159 | Lysozyme C (EC 3.2.1.17) (1,4-beta-N-acetylmuramidase C) | IKCAKKIARDAHGLT | 0.48 | 3.5 | 1.69 | 5.11 | 326 |
| Q5DF01 | SJCHGC01792 protein | VLKLWNSVLKHICNLS | 0.67 | 2.5 | 1.69 | 4.41 | 327 |
| B5L332 | CSF3 (Uncharacterized protein) | LRQLRSFMQDVFRSLRC | 0.56 | 3 | 1.68 | 8.12 | 328 |
| Q70PW6 | Peptidoglycan-recognition protein SB2 (EC 3.5.1.28) | GRHLLNELKKWP | 0.67 | 2.5 | 1.68 | 11.06 | 329 |
| P24296 | Non-specific lipid-transfer protein (LTP) (Phospholipid transfer protein) (PLTP) (ns-LTP1) (Fragment) | NCLKGIARGIHNLN | 0.67 | 2.5 | 1.67 | 8.2 | 330 |
| K7M000 | Uncharacterized protein | WRRVMHCFSYCW | 0.67 | 2.5 | 1.67 | 8.35 | 331 |
| P0C0P8 | Neuropeptide S | RSFRNGVGSGAKK | 0.42 | 4 | 1.66 | 12.31 | 332 |
| B9RZ82 | Putative uncharacterized protein | DLTRALHDLVKALKKAYRTLD | 0.66 | 2.5 | 1.66 | 5.64 | 333 |
| O46633 | Interferon tan (IFN-tau) (Antiluteolysin) (Trophoblast antiluteolytic protein) (Trophoblast protein 1) (TP-1) (Trophoblastin) | KRLRKMGGDLNS | 0.55 | 3 | 1.66 | 6.57 | 334 |

TABLE 4-continued

Priority alpha core peptide sequences

| Accession # | Name | Comp Form Match | HM | Q | HM*Q | PI | SEQ ID NO: |
|---|---|---|---|---|---|---|---|
| A0A093R5C1 | Uncharacterized protein (Fragment) | KNATTFIEKLMTFIRKA | 0.55 | 3 | 1.66 | 7.99 | 335 |
| M3VWX3 | Uncharacterized protein (Fragment) | EVIQLVKNLLNHLRR | 0.66 | 2.5 | 1.65 | 9.42 | 336 |
| G1T948 | Interleukin (Fragment) | LKEFLERLKSLIQKMIHQ | 0.66 | 2.5 | 1.65 | 9.67 | 337 |
| O64466 | Protein RALF-like 11 | VNEYSRGCSKIHRCR | 0.47 | 3.5 | 1.65 | 8.5 | 338 |
| F4ISE1 | Protein RALF-like 12 | VNEYSRGCSKIHRCR | 0.47 | 3.5 | 1.65 | 8.5 | 339 |
| F4ISE2 | Protein RALF-like 13 | VNEYSRGCSKIHRCR | 0.47 | 3.5 | 1.65 | 8.5 | 340 |
| M4QCE6 | Adipokinetic 3 | CGQFTRLCRHFVHELKQALTS | 0.55 | 3 | 1.65 | 6.45 | 341 |
| E9NX77 | AKH/corazonin-like hormone | CGQFTRLCRHFVHELKQALTS | 0.55 | 3 | 1.65 | 6.44 | 342 |
| Q9XSN5 | Apolipoprotein C-I (Apo-CI) (ApoC-I) (Apolipoprotein C1) [Cleaved into: Truncated apolipoprotein C-I] | DKAKKAIERIKQ | 0.55 | 3 | 1.64 | 9.11 | 343 |
| R0MG91 | Uncharacterized protein | EKISDWWKRIWEKIKN | 0.82 | 2 | 1.63 | 5.34 | 344 |
| P02815 | Mucin-like protein 2 (16.5 kDa submandibular gland glycoprotein) (Salivary protein 1) | LENMKTVIKSGVEKLKNFLQRG | 0.54 | 3 | 1.63 | 3.8 | 345 |
| A0A087VIJ1 | Uncharacterized protein | NATRFMEKLMTFVRKA | 0.54 | 3 | 1.62 | 8.87 | 346 |
| Q4G392 | 50S ribosomal protein L34, chloroplastic | RMATKAGRRVINAR | 0.32 | 5 | 1.62 | 12.96 | 347 |
| U3JCF4 | Uncharacterized protein (Fragment) | ILANFQRFLETAYRALRHL | 0.64 | 2.5 | 1.61 | 5.39 | 348 |
| Q9WVA8 | Pro-FMRFamide-related neuropeptide FF (FMRFamide-related | RFGRSAWGSWSK | 0.54 | 3 | 1.61 | 9.47 | 349 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | peptides) [Cleaved into: Neuropeptide SF (NPSF); Neuropeptide FF (NPFF); Neuropeptide AF-like (NPAF)] | | | | | | |
| A0A061HZA0 | Ras-related and estrogen-regulated growth inhibitor-like protein | THVKQAINKMLTK1SS | 0.46 | 3.5 | 1.61 | 5.48 | 350 |
| A8XRC0 | Protein CBG17503 | RELPKVCRNIFSRVSL | 0.53 | 3 | 1.60 | 5.86 | 351 |
| Q9TLU9 | 50S ribosomal protein L36, chloroplastic | ASVRKICSRCVALK | 0.40 | 4 | 1.60 | 11.48 | 352 |
| P06833 | Caltrin (Calcium transport inhibitor) (Peptide YY-2) (Peptide YY2) (Seminalplasmin) (SPLN) | LSRYAKLANRLANP | 0.53 | 3 | 1.60 | 10.36 | 353 |
| V5IDJ5 | Putative secreted protein (Fragment) | DILRECAKGLEVRVAENQHLANETV EYFFKKLWRGVKKVVKK | 0.35 | 4.5 | 1.60 | 5.86 | 354 |
| Q94CG1 | Glycine rich protein | YGCCRKGYNGCKRCCSYAGEAIDKV | 0.53 | 3 | 1.59 | 8.79 | 355 |
| D2K2T8 | Glycine-rich protein | YGCCRKGYNGCKRCCSYAGEAIDKV | 0.53 | 3 | 1.59 | 8.79 | 356 |
| G1NDN8 | Interleukin | QEFLNSFSKLMQKVIKIH | 0.64 | 2.5 | 1.59 | 9.07 | 357 |
| A4K2W7 | WAP four-disulfide core domain protein 5 | RCLSPMNHLCHK | 0.53 | 3 | 1.59 | 8.73 | 358 |
| A4K2T2 | WAP four-disulfide core domain protein 5 | RCLSPMNHLCHK | 0.53 | 3 | 1.59 | 8.73 | 359 |
| F9X658 | Uncharacterized protein | AFNAVKRLLDQARQLGR | 0.53 | 3 | 1.58 | 9.3 | 360 |

TABLE 4-continued

Priority alpha core peptide sequences

| Accession # | Name | Comp Form Match | HM | Q | HM*Q | PI | SEQ ID NO: |
|---|---|---|---|---|---|---|---|
| V5H076 | Putative secreted protein | AAKNALQKFIEEMKKIK | 0.53 | 3 | 1.58 | 6.14 | 361 |
| W2XXG7 | Uncharacterized protein | EVKKIWATIIERLYKLWRDW | 0.79 | 2 | 1.57 | 9.82 | 362 |
| P54615 | Osteocalcin-related protein (Gamma-carboxyglutamic acid-containing protein 3) (Nephrocalcin) (OC-X) | GLKTAYRRIYGI | 0.52 | 3 | 1.57 | 4.44 | 363 |
| P86546 | Osteocalcin (Bone Gla protein) (BGP) (Gamma-carboxyglutamic acid-containing protein) | GLKTAYKRIYGI | 0.52 | 3 | 1.56 | 4.44 | 364 |
| P86547 | Osteocalcin-2 (Bone Gla protein 2) (BGP2) (Gamma-carboxyglutamic acid-containing protein 2) | GLKTAYKRIYGI | 0.52 | 3 | 1.56 | 4.44 | 365 |
| V9NK57 | IL-4 delta 3 | LKDFLENLKRIMQK | 0.78 | 2 | 1.56 | 9.81 | 366 |
| V5H5J7 | Putative secreted protein | QVLHQVQKLANELLRKL | 0.62 | 2.5 | 1.56 | 9.69 | 367 |
| Q8GWK5 | Gibberellin-regulated protein 9 (GAST1 protein homolog 9) | CHRACGSCCAKC | 0.62 | 2.5 | 1.56 | 9.36 | 368 |
| P81765 | Tyrosinase inhibitor (Phenol oxidase inhibitor) (Phenoloxidase inhibitor) (POI) | QCLANGSKCYSHDVCCTKRCHNYA KKCVT | 0.31 | 5 | 1.56 | 8.32 | 369 |
| A0A091LH39 | Uncharacterized protein (Fragment) | KSATTFIEKLTTFIRKAS | 0.52 | 3 | 1.55 | 8.98 | 370 |
| Q7M1H2 | Glycine-rich protein | KGYYKGCKKCCSYAGQAMDKVTE | 0.52 | 3 | 1.55 | 9.28 | 371 |

TABLE 4-continued

Priority alpha core peptide sequences

| Accession # | Name | Comp Form Match | HM | Q | HM*Q | PI | SEQ ID NO: |
|---|---|---|---|---|---|---|---|
| A0A091FKF3 | Myelomonocytic growth factor (Fragment) | ILANFQRFLETAYRALRHLA | 0.62 | 2.5 | 1.55 | 6.57 | 372 |
| G5E3B9 | Putative udp-n-acetyl-alpha-d-galactosamine polypeptide n-acetyl galactos aminyltransferase (Fragment) | EGWSTLMRTVHSVIKR | 0.62 | 2.5 | 1.55 | 5.04 | 373 |
| D7MAD4 | Putative uncharacterized protein | DLSSVAKTLIHRLHK | 0.51 | 3 | 1.54 | 4.77 | 374 |
| P23137 | Glycine-rich protein | YGCCRKGYNGCKRCCSYAGEAMDKV | 0.51 | 3 | 1.53 | 8.29 | 375 |
| Q9FXS8 | Glycine rich protein (Glycine-rich protein) | YGCCRKGYNGCKRCCSYAGEAMDKV | 0.51 | 3 | 1.53 | 8.27 | 376 |
| Q9LWA1 | Cell wall protein (Glycine-rich protein) | YGCCRKGYNGCKRCCSYAGEAMDKV | 0.51 | 3 | 1.53 | 7.8 | 377 |
| P15460 | 2S seed storage protein 4 (2S albumin storage protein) (NWMU2-2S albumin 4) [Cleaved into: 2S seed storage protein 4 small subunit; 2S seed storage protein 4 large subunit] | VRKIYQAAKYLP | 0.51 | 3 | 1.53 | 10.32 | 378 |
| A9RBU6 | Uncharacterized protein | ASQLLKVLHKIWTQVP | 0.61 | 2.5 | 1.53 | 7.13 | 379 |
| Q4XR40 | Putative uncharacterized protein (Fragment) | VALVTGAGRGIGRSIAKTLAKSVSHVL | 0.34 | 4.5 | 1.52 | 9.95 | 380 |
| P01740 | T-cell receptor | RWSSGFHKVFAEGTKLI | 0.61 | 2.5 | 1.52 | 7.92 | 381 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | gamma chain V region V108A | | | | | | |
| G1LH25 | Interleukin | KEFLERLKSLIQRMIHQ | 0.60 | 2.5 | 1.50 | 9.66 | 382 |
| X2FJF4 | Interleukin-4 (Fragment) | KLSNMLRNLMHLVNQ | 0.60 | 2.5 | 1.50 | 6.13 | 383 |
| I3SFC2 | Uncharacterized protein | RVIKCIDHICQYARNL | 0.60 | 2.5 | 1.50 | 6.92 | 384 |
| A7KHG0 | Nodule Cysteine-Rich (NCR) secreted peptide (Nodule-specific cysteine-rich peptide 330) | RVIKCIDHICQYARNL | 0.60 | 2.5 | 1.50 | 6.06 | 385 |
| H2PE90 | Interleukin | KEFLERFKSLLQKMIHQ | 0.60 | 2.5 | 1.50 | 9.42 | 386 |
| H2QQ45 | Interleukin | KEFLERFKSLLQKMIHQ | 0.60 | 2.5 | 1.50 | 9.42 | 387 |
| G1RE48 | Interleukin | KEFLERFKSLLQKMIHQ | 0.60 | 2.5 | 1.50 | 9.42 | 388 |
| G3QY93 | Interleukin | KEFLERFKSLLQKMIHQ | 0.60 | 2.5 | 1.50 | 9.42 | 389 |
| Q9HBE4 | Interleukin-21 (IL-21) (Zal1) | KEFLERFKSLLQKMIHQ | 0.60 | 2.5 | 1.50 | 9.42 | 390 |
| F7EGQ8 | Interleukin | KEFLERFKSLLQKMIHQ | 0.60 | 2.5 | 1.50 | 9.12 | 391 |
| G7P680 | Interleukin | KEFLERFKSLLQKMIHQ | 0.60 | 2.5 | 1.50 | 9.12 | 392 |
| A0A096N144 | Uncharacterized protein | KEFLERFKSLLQKMIHQ | 0.60 | 2.5 | 1.50 | 9.12 | 393 |
| M3W5A3 | Interleukin | KEFLERLKSLIQKMIHQ | 0.60 | 2.5 | 1.50 | 9.51 | 394 |
| Q6L7I9 | Interleukin-21 (IL-21) | KEFLERLKSLIQKMIHQ | 0.60 | 2.5 | 1.50 | 9.42 | 395 |
| A2D655 | IL10 (Fragment) | HMLRDLRDAFSRVKTFF | 0.60 | 2.5 | 1.49 | 9.49 | 396 |
| A2D4R8 | IL10 (Fragment) | HMLRDLRDAFSRVKTFF | 0.60 | 2.5 | 1.49 | 9.49 | 397 |
| A2T6I1 | IL10 (Fragment) | HMLRDLRDAFSRVKTFF | 0.60 | 2.5 | 1.49 | 9.49 | 398 |
| G3SXC9 | Interleukin | KEFLERLKSLLQKMIHQ | 0.60 | 2.5 | 1.49 | 9.73 | 399 |
| A0A078GU36 | BnaCnng05800D protein | KKAASVIQKILKDFGL | 0.49 | 3 | 1.48 | 9.75 | 400 |
| M4FHC5 | Uncharacterized protein | KKAASVIQKILKDFGL | 0.49 | 3 | 1.48 | 9.75 | 401 |
| Q2V2Y3 | Putative defensin-like protein 84 | CMKKGGGHCQAYIGR | 0.42 | 3.5 | 1.48 | 8.88 | 402 |
| Q6V9X0 | Antileukoproteinase (ALP) (Secretory leukocyte | GALKCCKAMCGKVC | 0.49 | 3 | 1.47 | 8.6 | 403 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | protease inhibitor) | | | | | | |
| E0W4Y8 | Avh313 | KTLARWAQNAFSKLL | 0.49 | 3 | 1.47 | 10.14 | 404 |
| G5A7V2 | Putative uncharacterized protein | KTLARWAQNAFSKLL | 0.49 | 3 | 1.47 | 10.14 | 405 |
| I3MIK7 | Interleukin | KEFLERLKSLLQKMVHQ | 0.59 | 2.5 | 1.46 | 9.69 | 406 |
| P0DKV5 | Apolipoprotein C-I (Apo-CI) (ApoC-I) (Apolipoprotein C1) [Cleaved into: Truncated apolipoprotein C-I] | DKVREFFKRIKE | 0.73 | 2 | 1.46 | 8.28 | 407 |
| Q66KU1 | C-type lectin domain family 3 member A homolog (C-type lectin superfamily member 1 homolog) | GKWVDEVCRSLKKYI | 0.73 | 2 | 1.46 | 8.96 | 408 |
| A0A078FAD2 | BnaA09g39310D protein | SAMERLNNWLKTFKH | 0.58 | 2.5 | 1.45 | 7.98 | 409 |
| H0GU2 | YJL160C-like protein | VVSHIVSQIGDGQ LQITTAKKCCHK VHNCCSK | 0.32 | 4.5 | 1.44 | 9.06 | 410 |
| L7JS03 | Uncharacterized protein (Fragment) | RRCVNNFDDVFNSVFRKL | 0.72 | 2 | 1.44 | 7.82 | 411 |
| D7REK7 | Interleukin-4 | STLRDFLERLKKIMKE | 0.72 | 2 | 1.44 | 9.46 | 412 |
| Q865X5 | Interleukin-4 (IL-4) (B-cell stimulatory factor 1) (BSF-1) (Lymphocyte stimulatory factor 1) | STLRDFLERLKKIMKE | 0.72 | 2 | 1.44 | 9.46 | 413 |
| P51744 | Interleukin-4 (IL-4) (B-cell stimulatory factor 1) (BSF-1) (Lymphocyte stimulatory factor 1) | LKNLLERLKTIMKE | 0.72 | 2 | 1.44 | 9.51 | 414 |

TABLE 4-continued

Priority alpha core peptide sequences

| Accession # | Name | Comp Form Match | HM | Q | HM*Q | PI | SEQ ID NO: |
|---|---|---|---|---|---|---|---|
| Q9EQ14 | Interleukin-23 subunit alpha (IL-23 subunit alpha) (IL-23-A) (Interleukin-23 subunit p19) (IL-23p19) | SKILRSLQAFLAIAARVFA HGAA | 0.41 | 3.5 | 1.43 | 5.85 | 415 |
| Q91Z84 | Interleukin-23 subunit alpha (IL-23 subunit alpha) (IL-23-A) (Interleukin-23 subunit p19) (IL-23p19) | SKILRSLQAFLAIAARVFA HGAA | 0.41 | 3.5 | 1.43 | 5.63 | 416 |
| P06307 | Cholecystokinin (CCK) [Cleaved into: Cholecystokinin-58 (CCK58); Cholecystokinin-58 desnonopeptide ((1-49)-CCK58); Cholecystokinin-39 (CCK39); Cholecystokinin-33 (CCK33); Cholecystokinin-25 (CCK25); Cholecystokinin-18 (CCK18); Cholecystokinin-12 (CCK12); Cholecystokinin-8 (CCK8); Cholecystokinin-7 (CCK7); Cholecystokinin-5 (CCK5)] | AHLGALLARYIQQARKA | 0.41 | 3.5 | 1.43 | 9.7 | 417 |
| Q3E7Z9 | Uncharacterized protein YOL038C-A | MKYMGSFLRKAAT | 0.48 | 3 | 1.43 | 11.76 | 418 |
| P32648 | VIP peptides [Cleaved into: Intestinal peptide PHI-42; Intestinal peptide PHI-27 (Peptide histidine isoleucinamide 27); Vasoactive intestinal peptide (VIP) | AVKKYLNSILNGK | 0.48 | 3 | 1.43 | 6.76 | 419 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | (Vasoactive intestinal polypeptide)] | | | | | | |
| P01282 | VIP peptides [Cleaved into: Intestinal peptide PHV-42 (Peptide histidine valine 42); Intestinal peptide PHM-27 (Peptide histidine methioninamide 27); Vasoactive intestinal peptide (VIP) (Vasoactive intestinal polypeptide)] | AVKKYLNSILNGK | 0.48 | 3 | 1.43 | 6.76 | 420 |
| P01283 | VIP peptides [Cleaved into: Intestinal peptide PHV-42; Intestinal peptide PHI-27 (Peptide histidine isoleucinamide 27); Vasoactive intestinal peptide (VIP) (Vasoactive intestinal polypeptide)] | AVKKYLNSILNGK | 0.48 | 3 | 1.43 | 6.76 | 421 |
| P81401 | VIP peptides [Cleaved into: Intestinal peptide PHI-27 (Peptide histidine isoleucinamide 27); Vasoactive intestinal peptide (VIP) (Vasoactive intestinal polypeptide)] | AVKKYLNSILNGK | 0.48 | 3 | 1.43 | 6.75 | 422 |

TABLE 4-continued

Priority alpha core peptide sequences

| Accession # | Name | Comp Form Match | HM | Q | HM*Q | PI | SEQ ID NO: |
|---|---|---|---|---|---|---|---|
| Q76LU5 | Interleukin-21 (IL-21) | KEYLERLKSLIQKMIHQ | 0.57 | 2.5 | 1.43 | 9.46 | 423 |
| C7BVU1 | Putative DNA-binding response regulator CreB | KNVVEDIKKILQKMW | 0.71 | 2 | 1.43 | 4.56 | 424 |
| Q2V4J2 | Putative defensin-like protein 26 | QRCNRWCHNGCGNGKGGYYKSMSHGGQ | 0.29 | 5 | 1.43 | 8.46 | 425 |
| H0VLF2 | Interleukin | REFLERMKSLLQKMIHQ | 0.57 | 2.5 | 1.42 | 9.61 | 426 |
| D2HN52 | Interleukin (Fragment) | KEFLERLKSLIQRV | 0.71 | 2 | 1.42 | 9.66 | 427 |
| P01213 | Proenkephalin-B (Beta-neoendorphin-dynorphin) (Preprodynorphin) [Cleaved into: Alpha-neoendorphin; Beta-neoendorphin; Big dynorphin (Big Dyn); Dynorphin A(1-17) (Dyn-A17) (Dynorphin A); Dynorphin A(1-13); Dynorphin A (1-8); Leu-enkephalin; Rimorphin (Dynorphin B) (Dyn-B) (Dynorphin B (1-13)); Leumorphin (Dynorphin B-29)] | EDLYKRYGGFLRRI | 0.71 | 2 | 1.42 | 6.1 | 428 |
| P24514 | Chorion protein S18 | SSVAGVAKKGYRK | 0.35 | 4 | 1.42 | 9.82 | 429 |
| W9R9I1 | Uncharacterized protein | RRLLEAAKEIVSLMHK | 0.56 | 2.5 | 1.41 | 5.9 | 430 |
| G4LYD1 | MEG-5 | KTLGTAFKTLLHNLWDLLKQ | 0.56 | 2.5 | 1.40 | 8.18 | 431 |
| R7ULK2 | Uncharacterized protein (Fragment) | LIKRFSTLWRDIWQVASNF | 0.70 | 2 | 1.40 | 5.75 | 432 |
| P55030 | Interleukin-4 (IL-4) (B-cell stimulatory factor | LKDFLERLKAIMQK | 0.70 | 2 | 1.40 | 9.57 | 433 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | 1) (BSF-1) (Lymphocyte stimulatory factor 1) | | | | | | |
| Q3ECL0 | Protein RALF-like 9 | ANPYQRGCEKINRCR | 0.46 | 3 | 1.39 | 9.3 | 434 |
| B4LKD2 | GJ20154 | CRVARDFLRECMQHLKY | 0.56 | 2.5 | 1.39 | 5.49 | 435 |
| O95968 | Secretoglobin family 1D member 1 (Lipophilin-A) | KTLGKIAEKCDR | 0.69 | 2 | 1.39 | 9.47 | 436 |
| Q2V392 | Putative defensin-like protein 25 | QRCNRWCHNGCGNGKG | 0.40 | 3.5 | 1.39 | 8.39 | 437 |
| J7HBR9 | Maxadilan related protein | SKAKDAIAGLFTKAKSALKDVL | 0.46 | 3 | 1.38 | 9.78 | 438 |
| M3Z119 | Interleukin | KEFLERLKSLIQRMI | 0.69 | 2 | 1.38 | 9.37 | 439 |
| Q9TV67 | Interferon gamma (IFN-gamma) | RKAISELIRVMKDL | 0.69 | 2 | 1.38 | 9.8 | 440 |
| Q22T52 | Transmembrane protein, putative | KTIQSWLNKFLSCLHI | 0.55 | 2.5 | 1.38 | 7.7 | 441 |
| P0C5M1 | Uncharacterized protein YDR371C-A | MSAIVKWSNIIRPL | 0.69 | 2 | 1.38 | 9.99 | 442 |
| D3GGX2 | Interleukin | QEFLNSFSKLMQKLFKN | 0.68 | 2 | 1.37 | 9.32 | 443 |
| Q58IU6 | Interleukin | QEFLNSFSKLMQKLFKN | 0.68 | 2 | 1.37 | 9.3 | 444 |
| L7MA95 | Putative secreted peptide | ADKCLRYLLKNI | 0.68 | 2 | 1.37 | 9.59 | 445 |
| A0CK36 | Chromosome undetermined scaffold_2, whole genome shotgun sequence | FKNCVKNILKDCQT | 0.68 | 2 | 1.36 | 5.87 | 446 |
| A0A061J336 | Pterin-4-alpha-carbinolamine dehydratase | LARRMNEVFKEMLRP | 0.68 | 2 | 1.36 | 6.19 | 447 |
| C4R2P5 | Long chronological lifespan protein 2 | CKWVEKAWKGLL | 0.68 | 2 | 1.35 | 5.24 | 448 |
| P05105 | Lysozyme (EC 3.2.1.17) (1,4-beta-N-acetylmuramidase) | ISVAATCAKKIYK | 0.45 | 3 | 1.35 | 8.8 | 449 |

TABLE 4-continued

Priority alpha core peptide sequences

| Accession # | Name | Comp Form Match | HM | Q | HM*Q | PI | SEQ ID NO: |
|---|---|---|---|---|---|---|---|
| F4PF44 | Putative uncharacterized protein (Fragment) | NELKELVKKASDIIKK | 0.67 | 2 | 1.34 | 5 | 450 |
| P14730 | WAP four-disulfide core domain protein 18 (Extracellular peptidase inhibitor) (Protein WDNM1) (Fragment) | NIQKCCSNGCGHVCK | 0.54 | 2.5 | 1.34 | 8.77 | 451 |
| H3GQQ3 | Uncharacterized protein | NGLLQRIQSWWKNLFQHGAS | 0.54 | 2.5 | 1.34 | 9.29 | 452 |
| V9NJM6 | IL-4 delta 3 | TTLKDFLENLKRIMQK | 0.67 | 2 | 1.34 | 8.85 | 453 |
| A7KH73 | Nodule Cysteine-Rich (NCR) secreted peptide (Nodule-specific cysteine-rich peptide 54) (Uncharacterized protein) | FREIPQCINSICKCMKG | 0.67 | 2 | 1.34 | 6.5 | 454 |
| P48617 | Erythropoietin | DALSKLFRIYSNFLRG | 0.67 | 2 | 1.33 | 8.68 | 455 |
| P33709 | Erythropoietin | DALSKLFRIYSNFLRG | 0.67 | 2 | 1.33 | 8.68 | 456 |
| Q6QN06 | Matrix Gia protein (MGP) | GYNAAYNRYFRK | 0.44 | 3 | 1.33 | 9.39 | 457 |
| P08493 | Matrix Gia protein (MGP) (Cell growth-inhibiting gene 36 protein) | GYNAAYNRYFRK | 0.44 | 3 | 1.33 | 8.66 | 458 |
| W7XBW1 | Uncharacterized protein | DSIFSKMYNCWRKCA | 0.67 | 2 | 1.33 | 6.29 | 459 |
| P33622 | Apolipoprotein C-III (Apo-CIII) (ApoC-III) (Apolipoprotein C3) | FRFLKGYWSKFTD | 0.66 | 2 | 1.33 | 4.35 | 460 |
| W5U2R0 | Pro-sepiatocin | QELFSLLKRLINKVN | 0.66 | 2 | 1.32 | 8.35 | 461 |
| W5U1W8 | Sepiatocin | QELFSLLKRLINKVN | 0.66 | 2 | 1.32 | 7.92 | 462 |
| Q4TJ01 | Chromosome undetermined SCAF1215, | KLIDTVIKQLRNLIAT | 0.66 | 2 | 1.32 | 10.1 | 463 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | whole genome shotgun sequence | | | | | | |
| G1QEP5 | Uncharacterized protein (Fragment) | LLEKIKTCWNKILSGT | 0.66 | 2 | 1.32 | 8.48 | 464 |
| P0C7P5 | Bradykinin-potentiating and C-type natriuretic peptides (BPP-CNP) [Cleaved into: Bradykinin-potentiating peptide Tf1; Bradykinin-potentiating peptide Tf2; Bradykinin-potentiating peptide Tf3; C-type natriuretic peptide Tf-CNP; C-type natriuretic peptide Tf-CNP(3-22); C-type natriuretic peptide Tf-CNP(6-22)] | GGGGGGGGGGARRMKGLAKKAM | 0.26 | 5 | 1.32 | 11 | 465 |
| B7EY37 | cDNA clone:001-127-H01, full insert sequence | AAWFQFFNRFLKYITSL | 0.66 | 2 | 1.32 | 11.79 | 466 |
| G5ASQ0 | Interleukin-4 | TTLKDFLENLKTILKK | 0.66 | 2 | 1.31 | 8.78 | 467 |
| Q9FHA6 | Protein RALF-like 34 | VHPYSRGCSSITRCR | 0.37 | 3.5 | 1.31 | 10.63 | 468 |
| F7GL96 | Uncharacterized protein (Fragment) | LQS1LELVHRVLRHLAQ | 0.65 | 2 | 1.30 | 7.89 | 469 |
| H9KY95 | Uncharacterized protein (Fragment) | LQSFLELVHRVLRHLAQ | 0.65 | 2 | 1.30 | 6.4 | 470 |
| Q03461 | Non-specific lipid-transfer protein 2 (LTP 2) | CLKSAANAIKGI | 0.65 | 2 | 1.30 | 9.16 | 471 |
| V4MH62 | Uncharacterized protein | SVYAQLSSVARTMIKRLEHFI | 0.52 | 2.5 | 1.30 | 8.52 | 472 |

TABLE 4-continued

Priority alpha core peptide sequences

| Accession # | Name | Comp Form Match | HM | Q | HM*Q | PI | SEQ ID NO: |
|---|---|---|---|---|---|---|---|
| P63291 | Vasoactive intestinal peptide (VIP) (Vasoactive intestinal polypeptide) | AVKKYLNSILN | 0.65 | 2 | 1.29 | 9.82 | 473 |
| P63290 | Vasoactive intestinal peptide (VIP) (Vasoactive intestinal polypeptide) | AVKKYLNSILN | 0.65 | 2 | 1.29 | 9.82 | 474 |
| P84488 | Vasoactive intestinal peptide (VIP) (Vasoactive intestinal polypeptide) | AVKKYLNSILN | 0.65 | 2 | 1.29 | 9.82 | 475 |
| P63289 | Vasoactive intestinal peptide (VIP) (Vasoactive intestinal polypeptide) | AVKKYLNSILN | 0.65 | 2 | 1.29 | 9.82 | 476 |
| V5HF12 | Putative secreted protein | QVGQILRECAKNLKN | 0.65 | 2 | 1.29 | 4.75 | 477 |
| P01581 | Interferon gamma (IFN-gamma) | HKAVNELIRVIHQL | 0.65 | 2 | 1.29 | 9.48 | 478 |
| L7M2P0 | Uncharacterized protein | RLLHGLLHSLLHS FSHKFLDSFMRH MCTVCRNM | 0.23 | 5.5 | 1.29 | 9.84 | 479 |
| D8TM42 | Putative uncharacterized protein | YWIHMLRYVAKT | 0.52 | 2.5 | 1.29 | 9.58 | 480 |
| P13589 | Pituitary adenylate cyclase-activating polypeptide (PACAP) [Cleaved into: PACAP-related peptide (PRP-48); Pituitary adenylate cyclase-activating polypeptide 27 (PACAP-27) (PACAP27); Pituitary adenylate cyclase-activating polypeptide 38 (PACAP-38) (PACAP38)] | AVKKYLAAVLGK | 0.43 | 3 | 1.29 | 5.61 | 481 |

TABLE 4-continued

Priority alpha core peptide sequences

| Accession # | Name | Comp Form Match | HM | Q | HM*Q | PI | SEQ ID NO: |
|---|---|---|---|---|---|---|---|
| P41535 | Pituitary adenylate cyclase-activating polypeptide (PACAP) [Cleaved into: PACAP-related peptide (PRP-48); Pituitary adenylate cyclase-activating polypeptide 27 (PACAP-27) (PACAP27); Pituitary adenylate cyclase-activating polypeptide 38 (PACAP-38) (PACAP38)] | AVKKYLAAVLGK | 0.43 | 3 | 1.29 | 5.57 | 482 |
| P16613 | Pituitary adenylate cyclase-activating polypeptide (PACAP) [Cleaved into: PACAP-related peptide (PRP-48); Pituitary adenylate cyclase-activating polypeptide 27 (PACAP-27) (PACAP27); Pituitary adenylate cyclase-activating polypeptide 38 (PACAP-38) (PACAP38)] | AVKKYLAAVLGK | 0.43 | 3 | 1.29 | 5.54 | 483 |
| P18509 | Pituitary adenylate cyclase-activating polypeptide (PACAP) [Cleaved into: PACAP-related peptide (PRP-48); Pituitary adenylate cyclase-activating polypeptide 27 (PACAP-27) (PACAP27); Pituitary adenylate cyclase-activating | AVKKYLAAVLGK | 0.43 | 3 | 1.29 | 5.38 | 484 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | polypeptide 38 (PACAP-38) (PACAP38)] | | | | | | |
| O70176 | Pituitary adenylate cyclase-activating polypeptide (PACAP) [Cleaved into: PACAP-related peptide (PRP-48); Pituitary adenylate cyclase-activating polypeptide 27 (PACAP-27) (PACAP27); Pituitary adenylate cyclase-activating polypeptide 38 (PACAP-38) (PACAP38)] | AVKKYLAAVLGK | 0.43 | 3 | 1.29 | 5 | 485 |
| Q29W19 | Pituitary adenylate cyclase-activating polypeptide (PACAP) [Cleaved into: PACAP-related peptide (PRP-48); Pituitary adenylate cyclase-activating polypeptide 27 (PACAP-27) (PACAP27); Pituitary adenylate cyclase-activating polypeptide 38 (PACAP-38) (PACAP38)] | AVKKYLAAVLGK | 0.43 | 3 | 1.29 | 4.91 | 486 |
| P41534 | Glucagon family neuropeptides [Cleaved into: Growth hormone-releasing factor 1-46 (GRF) (Growth hormone-releasing hormone) (GHRH); Pituitary adenylate cyclase-activating polypeptide 27 | AVKKYLAAVLGK | 0.43 | 3 | 1.29 | 9.4 | 487 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | (PACAP-27) (PACAP27); Pituitary adenylate cyclase-activating polypeptide 38 (PACAP-38) (PACAP38)] | | | | | | |
| P41585 | Glucagon family neuropeptides [Cleaved into: Growth hormone-releasing factor (GRF) (Growth hormone-releasing hormone) (GHRH); Pituitary adenylate cyclase-activating polypeptide (PACAP)] | AVKKYLAAVLGK | 0.43 | 3 | 1.29 | 9.31 | 488 |
| Q09169 | Glucagon family neuropeptides [Cleaved into: Growth hormone-releasing factor (GRF) (Growth hormone-releasing hormone) (GHRH); Pituitary adenylate cyclase-activating polypeptide 27 (PACAP-27) (PACAP27); Pituitary adenylate cyclase-activating polypeptide 38 (PACAP-38) (PACAP38)] | AVKKYLAAVLGK | 0.43 | 3 | 1.29 | 6.28 | 489 |
| V9LKT2 | Interleukin | LKKFLQFIYYCC | 0.64 | 2 | 1.28 | 5.61 | 490 |
| D0N540 | Secreted RxLR effector peptide protein, putative (Fragment) | LSDAKQWIKTMFKNW | 0.64 | 2 | 1.28 | 5.96 | 491 |
| C9X4J0 | Bradykinin-potentiating peptide (BPP) (TdBPP) | AKGKQMLKEYANKV | 0.43 | 3 | 1.28 | 10 | 492 |

TABLE 4-continued

Priority alpha core peptide sequences

| Accession # | Name | Comp Form Match | HM | Q | HM*Q | PI | SEQ ID NO: |
|---|---|---|---|---|---|---|---|
| P42692 | Somatoliberin (Growth hormone-releasing factor) (GRF) (Growth hormone-releasing hormone) (GHRH) | GMFNKAYRKALGQLSA | 0.43 | 3 | 1.28 | 9.31 | 493 |
| A8MQI8 | Protein RALF-like 5 | GGLSTWKKLLDTILKIP | 0.64 | 2 | 1.27 | 9.79 | 494 |
| A2ZAS9 | Non-specific lipid-transfer protein 3 (LTP 3) | CLKNMASSFRNLN | 0.63 | 2 | 1.27 | 8.92 | 495 |
| Q2QYL3 | Non-specific lipid-transfer protein 3 (LTP 3) | CLKNMASSFRNLN | 0.63 | 2 | 1.27 | 8.92 | 496 |
| L0GB04 | La1-like protein 15 | VTCASQALKRGCKSV | 0.42 | 3 | 1.27 | 9.03 | 497 |
| G1TIN8 | Uncharacterized protein | CSSWPHLLREILRAARL | 0.51 | 2.5 | 1.27 | 7.83 | 498 |
| O35735 | Interferon gamma (IFN-gamma) | RKAVSELKKVMNDLL | 0.63 | 2 | 1.27 | 9.84 | 499 |
| B4LY36 | GJ24431 | GQVRNFGNACEKIVHSCKTG | 0.51 | 2.5 | 1.26 | 5.29 | 500 |
| Q99935 | Opiorphin prepropeptide (Basic proline-rich lacrimal protein) (Proline-rich protein 1) (PRL1) [Cleaved into: Opiorphin] | AFKSFWQKLFAIFG | 0.63 | 2 | 1.26 | 10.7 | 501 |
| P02659 | Apovitellenin-1 (Apo-VLDL-II) (Apo-II) (Apovitellenin I) (Very low density lipoprotein II) | ARLTKLAEQLMEKIKNLC | 0.63 | 2 | 1.26 | 9.21 | 502 |
| Q9YGI2 | Probable weak neurotoxin NN AMI | GKRYIRGCADTC | 0.63 | 2 | 1.26 | 8.99 | 503 |

TABLE 4-continued

Priority alpha core peptide sequences

| Accession # | Name | Comp Form Match | HM | Q | HM*Q | PI | SEQ ID NO: |
|---|---|---|---|---|---|---|---|
| O49320 | Protein RALF-like 18 | NKYRRGCSAATGCYRF | 0.32 | 4 | 1.26 | 9.7 | 504 |
| Q29146 | Beta-lactoglobulin (Beta-LG) | NKGMEEFKKIVRTLT | 0.63 | 2 | 1.26 | 4.91 | 505 |
| Q9TWH3 | Venom peptide isomerase light chain | VATVKNCGKKLLAT | 0.42 | 3 | 1.26 | 9.79 | 506 |
| A1YEU0 | IL10 (Fragment) | NMLRDLRDAFSRVKTFF | 0.63 | 2 | 1.26 | 7.99 | 507 |
| Q6LBF4 | Interleukin-10 (Fragment) | NMLRDLRDAFSRVKTFF | 0.63 | 2 | 1.26 | 7.97 | 508 |
| Q9BDX4 | Interleukin-3 (IL-3) (Hematopoietic growth factor) (Mast cell growth factor) (MCGF) (Multipotential colony-stimulating factor) (P-cell-stimulating factor) | RKLKKYLEALDNFLNF | 0.63 | 2 | 1.26 | 5.45 | 509 |
| Q29FI2 | GA12182 | KHAHSMITSMLTFVSSVMNFGRSFVKD | 0.42 | 3 | 1.26 | 9.52 | 510 |
| B4H186 | GL22527 | KHAHSMITSMLTFVSSVMNFGRSFVKD | 0.42 | 3 | 1.26 | 9.52 | 511 |
| O77559 | ADM [Cleaved into: Adrenomedullin (AM); Proadrenomedullin N-20 terminal peptide (ProAM N-terminal 20 peptide) (PAMP) (ProAM-N20)] | RAHQVLANLLKM | 0.50 | 2.5 | 1.26 | 11 | 512 |
| O97944 | Alpha-S2-casein | QKFLNKIYQYYQTFL | 0.63 | 2 | 1.25 | 5.8 | 513 |
| Q8WT56 | Fatty-acid and retinol-binding protein 1 (Ls-FAR-1) | EKFKRIANSFLQ | 0.63 | 2 | 1.25 | 8.81 | 514 |
| Q25619 | Fatty-acid and retinol-binding protein 1 | EKFKRIANSFLQ | 0.63 | 2 | 1.25 | 8.62 | 515 |

TABLE 4-continued

Priority alpha core peptide sequences

| Accession # | Name | Comp Form Match | HM | Q | HM*Q | PI | SEQ ID NO: |
|---|---|---|---|---|---|---|---|
| | (Antigen maltose-binding protein) (Ov-FAR-1) (Ov20) (OvMBP/11) (OvS1) (S1 protein) | | | | | | |
| O43555 | Progonadoliberin-2 (Progonadoliberin II) [Cleaved into: Gonadoliberin-2 (Gonadoliberin II) (Gonadotropin-releasing hormone II) (GnRH II) (Luliberin II) (Luteinizing hormone-releasing hormone II) (LH-RH II); GnRH-associated peptide 2 (GnRH-associated peptide II)] | RHLARTLLTAARE | 0.42 | 2.5 | 1.06 | 10.8 | 516 |
| K9M1U5 | Interferon lambda-4 (IFN-lambda-4) | CARLRHVARGIADAQAVLSGL | 0.36 | 2.5 | 0.89 | 11.3 | 517 |

Figure 9:
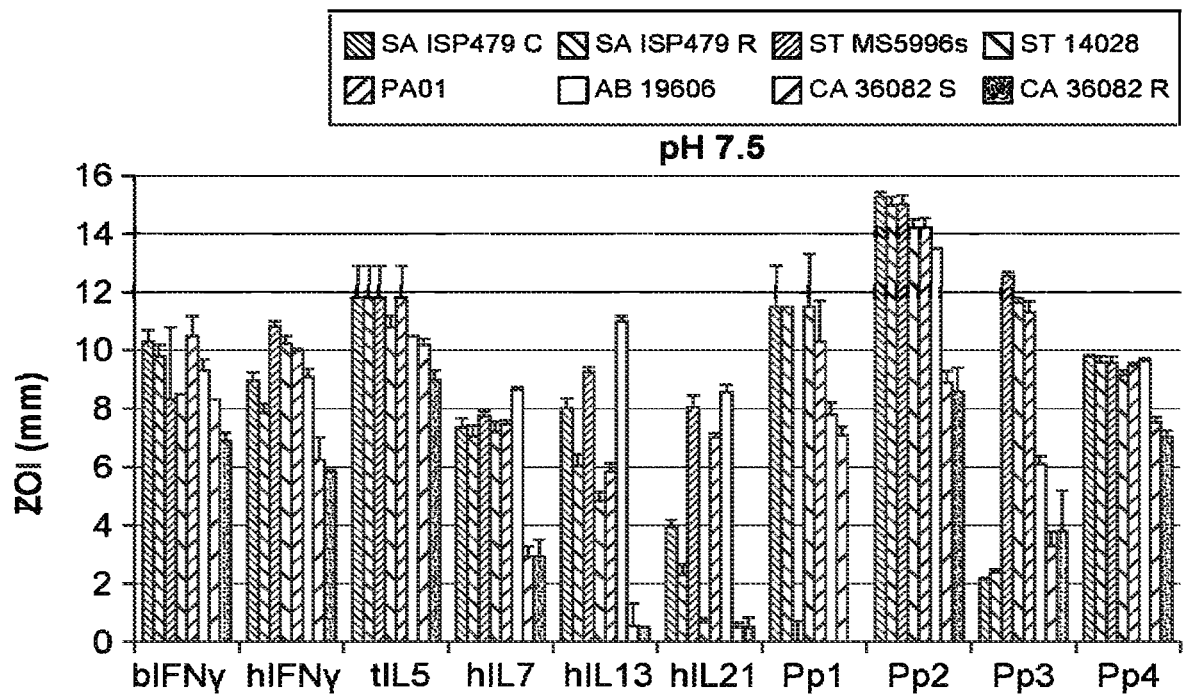
FIG. 9 shows the antimicrobial activity of study test peptides (IL-5 (SEQ ID NO:1); IL-7 (SEQ ID NO:2); IL-13 (SEQ ID NO:3); IL-21 (SEQ ID NO:4); bIFN-γ (SEQ ID NO:5); hIFN-γ (SEQ ID NO:6); Pp-1 (SEQ ID NO:7); Pp-2 (SEQ ID NO:8); Pp-3 (SEQ ID NO:9); Pp-4 (SEQ ID NO:10)). Microbicidal activity of study test peptides versus a panel of prototypic gram-positive (*S. aureus*), gram-negative (*S. typhimurium, P. aeruginosa, A. baumannii*) and fungal (*C. albicans*) pathogens at two pH's representing native physiologic (pH 7.5) or phagolysosomal (pH 5.5) environments.
Figure 9:
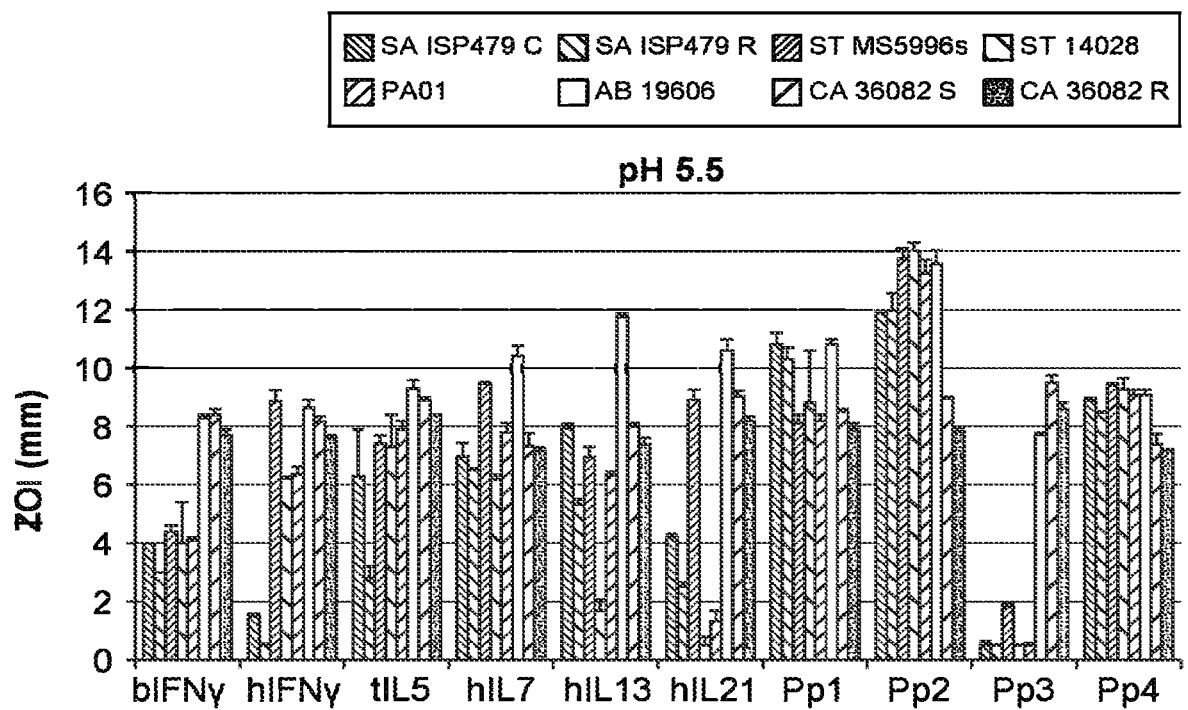

When assessed against a panel of prototypic and important human pathogens, it was found that the study test peptides had potent activity against nearly all of the organisms considered (FIG. 9). In particular, of the interleukins, sequences derived from turkey IL-5 (tIL-5) were markedly potent against all organisms at pH's representative of physiologic (pH 7.5) and septic/wound (pH 5.5) environments. Sequences derived from human interleukins (hIL-7, hIL-13, hIL-21) were somewhat less potent at pH 7.5, though retained significant activity at the physiologically important pH 5.5. Likewise, the peptides derived from human and bat IFN-γ had significant activity against most organisms, being somewhat more potent at pH 7.5 than 5.5. Of the study test peptides, perhaps some of the most impressive were derived from *Phytophthora*. While Pp-1 and Pp-4 had significant activity against many organisms, Pp-2 was particularly potent against bacteria and fungi, activities that were retained at pH 5.5.

This example has utilized an alternate computational approach to screen for conserved elements common to a singular class of AHAPs as a means towards discovering universal sequence and structural elements that may confer microbicidal activity. Here, this example first identified a consensus sequence that was common to a majority of known AHAPs. This consensus was then subjected to an iterative refinement, based on alignments with both sequence and structure databases, to generate a linear formula that described an amphipathic helical span that was representative of most known AHAPs. In particular, this sequence formula consisted of a 18 residue span that included the following polar [EDKRHQNTS(AG)] and non-polar [VMCILFWY(AG)] residues. When translated into a three dimensional radial array, this α-core formula describes an idealized amphipathic helix comprised of equivalent polar and non-polar facets (FIGS. 1A-B and 2).

One component of the iterative optimization of the α-core formula involved queries against a control AHAP dataset. These studies revealed that glycine and alanine were critical elements found within AHAP amphipathic domains, as preliminary versions of the formula lacking these residues were largely unsuccessful, retrieving fewer than 10% of control AHAP sequences. Given the inherent amphipathic frequency of the α-core formula, it was possible to assess the positional requirement for specific residues on either the polar or non-polar face of an amphipathic helix. Initial studies with glycine indicated that it was essential that this residue be included with both the polar and non-polar residue search terms, as omission from either group dramatically reduced the number of returned sequences from the control dataset. Likewise, similar studies with alanine, revealed that it was important to include this residue with both the polar and non-polar residue groups to efficiently retrieve most AHAPs from the control dataset. As the α-core formula is translated into a three dimensional helical array, these studies further indicated that alanine and glycine are likely to be found on either the polar or non-polar face of AHAP amphipathic helices.

Similar to the above sequence-based optimization studies, structure-based alignments with the PDB database were also carried out. These studies revealed that while the inclusion of proline in the formula dramatically reduced the number of retrieved helices, glycine and alanine were tolerated and were commonly found in helical spans. These studies further revealed that the α-core sequence formula retrieved helical spans with a high degree of fidelity, correctly identifying such domains more than 90% of the time. While the α-core formula was not designed as a secondary structure characterization tool, its efficiency in identifying helical spans compares favorably with such tools which correctly identify helices with frequencies ranging from xx to 81.5%.

Database Searches

Once the α-core formula was refined, it was used as a query against the SwissProt database. These studies revealed that it retrieved nearly all classes of AHAPs (94%) and approximately 89% of all known individual AHAPs with a relatively high degree of specificity. Upon examination, those individual peptides or peptide families that were not retrieved by the formula were often found to have relatively short stretches of amphipathicity or interrupted helical domains, such as the "ranabox" peptides of amphibians which are characterized as having a C-terminal helix-turn-helix domain.

It is noteworthy that while the formula describes an idealized perfectly amphipathic helix, it successfully retrieved nearly all classes, and most individual AHAPs. This suggests that nearly all AHAPs have a span of near perfect amphipathicity for at least a 12 residue span representing the size of the domain queried in these studies. Given this observation, it supports the current hypothesis that amphipathicity is a critical component of microbicidal activity and is likely essential for the membrane permeabilizing properties of AHAPs.

Residue Frequency within AHAP Helices

As the α-core sequence formula returns aligned datasets, it was possible to assess the relative frequency of various residues within AHAP α-helical spans. Moreover, these data allowed for some generalizations to be made regarding universal features common to AHAP helices. Overall, beyond the inherent amphipathicity found within AHAPs, these data revealed that several residues were strongly favored within amphipathic helices derived from various classes of organisms.

Glycine

One notable finding from these studies was that glycine is highly represented in AHAP helices from arthropods and amphibians (30-35% of all residues), whereas it occurs less frequently in mammals (15% of all residues).

Glycine in AHAP Helices of Arthropods and Amphibians

The presence of glycine within a majority of known AHAP helices would not initially be expected as this residue is known to destabilize α-helical structures. However, as was demonstrated by a large body of empirical evidence, many α-helical peptides are unstructured in aqueous environments, only to adopt an α-helical conformation in hydrophobic milieus. While the mechanism by which this occurs is not known, it is possible that peptides may become organized at the target as the relatively electronegative microbial surface may help to orient the cationic and other polar residues to one face of the amphipathic helical structure. In a similar fashion, the hydrophobic interior of the microbial plasma membrane may also help to organize the random coil structure by selectively interacting with hydrophobic residues within the peptide.

This lack of amphipathic organization prior to interaction with the target may be an important mechanism behind the selective toxicity of AHAPs that allows them to limit activity towards the host while still being able to adopt a microbicidal conformation as necessary when interacting with the target microbe.

Glycine in AHAP Helices of Higher Eukaryotes

One caveat regarding the presence of glycine in AHAP helices is that while it is common in the short peptides found within lower organisms, it occurs less frequently in the longer AHAPs of higher eukaryotes as well as in proteins with mixed domain architectures such as the chemokines, granulysin and NK lysin. If the supposition that glycine is an important means to keep AHAPs in an unstructured and inactive state prior to interaction with their microbial target, the lack of glycine in these larger peptides suggests that they may use an alternate means of microbicidal dampening to limit toxicity towards the host.

Cationic Residues in AHAP Helices of Arthropods and Amphibians

Beyond demonstrating an abundance of glycine in AHAP helices, residue frequency studies also revealed that lysine is highly favored over arginine in the amphipathic helices of the AHAPs considered in this study. Lysine was the most abundant cationic residue in study AHAP helices, where it was strongly preferred over arginine in non-mammalian peptides at a 12:1 ratio. In mammals, lysine was still preferred over arginine, but to a lesser extent with a 3:1 ratio. By comparison, lysine was less abundant in toxins where it was preferred over arginine at a 2:1 ratio.

It may be of some relevance that biophysical measures have demonstrated lysine is less efficient at generating membrane destabilizing NGC than arginine, as it can only interact with a single lipid head group at a time. Because of this, AHAPs that are rich in lysine often compensate for this lack of permeabilizing ability by having an increased mean hydrophobicity, in what has been termed the 'saddle-splay curvature selection' rule. In the current study, AHAP helices largely support this rule with the finding that, as the relative abundance of lysine is increased ($N_K/N_K+N_R$), mean peptide hydrophobicity is also increased.

Biophysical Properties of AHAP Helices as Compared with Other α-Helical Domains

Beyond measurements of residue frequency, a number of additional properties of helices retrieved by the α-core formula were determined including: Q, µH, H. When averaged across families, these quantitative data revealed a number of insights regarding the biophysical properties of retrieved AHAP helices versus those of toxins and other groups.

One defining characteristic of AHAPs is that they are typically cationic in nature, a property that has been shown to enhance their selectivity towards the relatively electronegative surface of many microorganisms. The universality of this biophysical property is supported by findings from the current study, where amphipathic helices derived from AHAPs had an average net charge of +2.0 over a twelve residue span. Moreover, if only cationic AHAPs are considered (Q≥0.5 for 707 of 803 retrieved sequences), this value rises to +2.7. By comparison the average charge for toxin and other helices retrieved in these studies was +1.3 and +0.6 respectively, suggesting that cationicity may be selectively favored in AHAPs as compared with other amphipathic peptides.

Another characteristic feature of AHAPs is that they are frequently amphipathic in nature, a property that has been deemed essential for their membrane permeabilizing activities towards microbes. As the α-core formula searches for amphipathic sequences, all of the helices returned by these queries were a priori amphipathic in nature. However, it was still of interest to compare the relative amphipathicity, as quantitated by µH, of identified helices between various classes of peptides. Results from the current study support the theory that amphipathicity is an essential biophysical property of AHAPs as the average hydrophobic moment for study AHAP helices was 0.52, a relatively high value when compared to archetypal amphipathic helices such as cecropin A ($\mu H_{max}=0.61$) or LL-37 ($\mu H_{max}=0.78$). In comparison, the amphipathicity of helices derived from toxins and other proteins were somewhat lower at µH=0.42 and 0.39 respectively.

In addition, mean hydrophobicity (H) was somewhat greater for AHAPs (0.42) than for toxins (0.34) or other study peptides (0.39). This observation suggests that a moderate level of hydrophobicity may be essential for the membrane permeabilizing properties of AHAPs.

Identify New Antimicrobial Sequences

The α-core sequence formula also retrieved a large number of uncharacterized sequences as well as proteins with an alternate primary function. Given the fidelity of retrieving antimicrobial sequences, it was of interest to determine whether some of these alternate sequences might also possess antimicrobial properties. As described, putative microbicidal sequences were scored for properties that were most discriminative at separating AHAPs from other sequences (µH*Q or µH*PI) and lead candidates of biological interest were synthesized for further study.

Representative peptide helices from three separate high-scoring groups, interleukins (tIL-5, hIL-7, hIL-13 and hIL-21), interferons (bIFN-γ, hIFN-γ) and uncharacterized sequences from *P. parasitica* were synthesized and tested for their microbicidal activity. Notably, all of these peptides displayed potent microbicidal activity, which in many cases was greater than that of classic AHAPs such as LL-37. These data strongly suggest that the amphipathic sequence formula can successfully identify amphipathic helices with antimicrobial properties.

Unless otherwise defined, all technical and scientific terms used herein have the same meaning as commonly understood by one of ordinary skill in the art to which this disclosure belongs.

The disclosures illustratively described herein may suitably be practiced in the absence of any element or elements, limitation or limitations, not specifically disclosed herein. Thus, for example, the terms "comprising", "including," "containing", etc. shall be read expansively and without limitation. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the disclosure claimed.

Thus, it should be understood that although the present disclosure has been specifically disclosed by preferred embodiments and optional features, modification, improvement and variation of the disclosures embodied therein herein disclosed may be resorted to by those skilled in the art, and that such modifications, improvements and variations are considered to be within the scope of this disclosure. The materials, methods, and examples provided here are representative of preferred embodiments, are exemplary, and are not intended as limitations on the scope of the disclosure.

The disclosure has been described broadly and generically herein. Each of the narrower species and subgeneric groupings falling within the generic disclosure also form part of the disclosure. This includes the generic description of the disclosure with a proviso or negative limitation removing any subject matter from the genus, regardless of whether or not the excised material is specifically recited herein.

In addition, where features or aspects of the disclosure are described in terms of Markush groups, those skilled in the art will recognize that the disclosure is also thereby described in terms of any individual member or subgroup of members of the Markush group.

All publications, patent applications, patents, and other references mentioned herein are expressly incorporated by reference in their entirety, to the same extent as if each were incorporated by reference individually. In case of conflict, the present specification, including definitions, will control.

It is to be understood that while the disclosure has been described in conjunction with the above embodiments, that the foregoing description and examples are intended to illustrate and not limit the scope of the disclosure. Other aspects, advantages and modifications within the scope of the disclosure will be apparent to those skilled in the art to which the disclosure pertains.

SEQUENCE LISTING (6884 sequences)

SEQ ID NO: 1 - protein, 19 aa, synthetic construct
  REGION 1..19: note = Synthetic
KRFIEKLRTFLRKLSRGAK

SEQ ID NO: 2 - protein, 25 aa, synthetic construct
  REGION 1..25: note = Synthetic
LCFLKRLLQEIKTCWNKILMGTKEH

SEQ ID NO: 3 - protein, 23 aa, synthetic construct
  REGION 1..23: note = Synthetic
EVAQFVKDLLLHLKKLFREGRFN

SEQ ID NO: 4 - protein, 29 aa, synthetic construct
  REGION 1..29: note = Synthetic
KEFLERFKSLLQKMIHQHLSSRTHGSEDS

SEQ ID NO: 5 - protein, 35 aa, synthetic construct
  REGION 1..35: note = Synthetic
KAISELYNVITELSKSNSKMRKRRQNLFRGWKASK

SEQ ID NO: 6 - protein, 35 aa, synthetic construct
  REGION 1..35: note = Synthetic
AIHELIQVMAELSPAAKTGKRKRSQMLFRGRRASQ

SEQ ID NO: 7 - protein, 20 aa, synthetic construct
  REGION 1..20: note = Synthetic
TQAWTNFKKWFKKWFKKTFS

SEQ ID NO: 8 - protein, 27 aa, synthetic construct
  REGION 1..27: note = Synthetic
LFQKIKRWWKRIFEHEASRSARRLRAV

SEQ ID NO: 9 - protein, 20 aa, synthetic construct
  REGION 1..20: note = Synthetic
KEVIKKFTKAMEKMKKNGRA

SEQ ID NO: 10 - protein, 27 aa, synthetic construct
  REGION 1..27: note = Synthetic
LWQRFLRWWNRLFHVSSNRLLREGGKK

SEQ ID NO: 11 - protein, 17 aa, synthetic construct
  REGION 1..17: note = Synthetic
YGGFLRRIRPKLKWDNQ

SEQ ID NO: 12 - protein, 29 aa, synthetic construct
  REGION 1..29: note = Synthetic
KEFLERFKSLLQKMIHQHLSSRTHGSEDS

SEQ ID NO: 13 - protein, 32 aa, synthetic construct
  REGION 1..32: note = Synthetic
YGGFLRRIRPKLKWDNQKRYGGFLRRQFKVVT

SEQ ID NO: 14 - protein, 60 aa, synthetic construct
  REGION 1..60: note = Synthetic
RFLHGYHRFMHSVGRVFSKWGESPNRSRRHSPHQALRKGVRRTRPSRKGKRLMTRGQLPR

SEQ ID NO: 15 - protein, 21 aa, synthetic construct
  REGION 1..21: note = Synthetic
CPTAQLIATLKNGRKICLDLQ

SEQ ID NO: 16 - protein, 22 aa, synthetic construct
  REGION 1..22: note = Synthetic
CPTAQLIATLKNGRKICLDLQP

SEQ ID NO: 17 - protein, 23 aa, synthetic construct
  REGION 1..23: note = Synthetic
CPTAQLIATLKNGRKICLDLQAP

SEQ ID NO: 18 - protein, 22 aa, synthetic construct
  REGION 1..22: note = Synthetic
CPTAQLIATLKNGRKICLDLQA

SEQ ID NO: 19 - protein, 14 aa, synthetic construct
  REGION 1..14: note = Synthetic
RIKKFLKRCCKKIK

SEQ ID NO: 20 - protein, 14 aa, synthetic construct
  REGION 1..14: note = Synthetic
RIKKFLKRCCKKIK

SEQ ID NO: 21 - protein, 14 aa, synthetic construct
  REGION 1..14: note = Synthetic
RIKKFLKRCCKKIK

SEQ ID NO: 22 - protein, 22 aa, synthetic construct
  REGION 1..22: note = Synthetic
FLKKLLQKIKTCWNKILRGIKE

SEQ ID NO: 23 - protein, 16 aa, synthetic construct
  REGION 1..16: note = Synthetic
KRVKRFCKKACRKASQ

SEQ ID NO: 24 - protein, 16 aa, synthetic construct
  REGION 1..16: note = Synthetic
KRVKRFCKKACRKASQ

SEQ ID NO: 25 - protein, 18 aa, synthetic construct
  REGION 1..18: note = Synthetic
KNVKRFIEKLRTFLRKLS

SEQ ID NO: 26 - protein, 12 aa, synthetic construct
  REGION 1..12: note = Synthetic
LVRKIIKYCRKL

SEQ ID NO: 27 - protein, 12 aa, synthetic construct
  REGION 1..12: note = Synthetic
LVRKIIKYCRKL

SEQ ID NO: 28 - protein, 14 aa, synthetic construct
  REGION 1..14: note = Synthetic
FRRLCRNIKEVIKK

SEQ ID NO: 29 - protein, 17 aa, synthetic construct
  REGION 1..17: note = Synthetic
TQAWTNFKKWFKKWFKK

SEQ ID NO: 30 - protein, 17 aa, synthetic construct
  REGION 1..17: note = Synthetic
TQAWTNFKKWFKKWFKK

SEQ ID NO: 31 - protein, 17 aa, synthetic construct
  REGION 1..17: note = Synthetic
TQAWTNFKKWFKKWFKK

SEQ ID NO: 32 - protein, 17 aa, synthetic construct
  REGION 1..17: note = Synthetic
TQAWTNFKKWFKKWFKK

SEQ ID NO: 33 - protein, 15 aa, synthetic construct
  REGION 1..15: note = Synthetic
VKKFIEKLRTFIRKL

SEQ ID NO: 34 - protein, 15 aa, synthetic construct
  REGION 1..15: note = Synthetic
VKKFIEKLRTFIRKL

SEQ ID NO: 35 - protein, 15 aa, synthetic construct
  REGION 1..15: note = Synthetic
VKKFIEKLRTFIRKL

SEQ ID NO: 36 - protein, 16 aa, synthetic construct
  REGION 1..16: note = Synthetic
KEFLKSFAKLIRKVIR

SEQ ID NO: 37 - protein, 16 aa, synthetic construct
  REGION 1..16: note = Synthetic
KEFLKSFAKLIKKVIR

SEQ ID NO: 38 - protein, 16 aa, synthetic construct
  REGION 1..16: note = Synthetic
KEFLKSFAKLIKKVIR

SEQ ID NO: 39 - protein, 16 aa, synthetic construct
  REGION 1..16: note = Synthetic
KEFLKSFAKLIKKVIR

SEQ ID NO: 40 - protein, 16 aa, synthetic construct
  REGION 1..16: note = Synthetic
KEFLKSFAKLIKKVIR

SEQ ID NO: 41 - protein, 16 aa, synthetic construct
  REGION 1..16: note = Synthetic
KEFLKSLAKLIKKVIR

SEQ ID NO: 42 - protein, 16 aa, synthetic construct
  REGION 1..16: note = Synthetic
FFKWISKFIRRLSKCG

SEQ ID NO: 43 - protein, 15 aa, synthetic construct
  REGION 1..15: note = Synthetic
ANKANRMMRKIMRKL

SEQ ID NO: 44 - protein, 27 aa, synthetic construct
  REGION 1..27: note = Synthetic
WYQLIRTFGNLIHQKYRKLLEAYRKLR

SEQ ID NO: 45 - protein, 19 aa, synthetic construct
  REGION 1..19: note = Synthetic
FLKRLLREIKTCWNKILKG

SEQ ID NO: 46 - protein, 19 aa, synthetic construct
  REGION 1..19: note = Synthetic
FLKRLLREIKTCWNKILKG

SEQ ID NO: 47 - protein, 19 aa, synthetic construct
  REGION 1..19: note = Synthetic
FLKRLLREIKTCWNKILKG

SEQ ID NO: 48 - protein, 18 aa, synthetic construct
  REGION 1..18: note = Synthetic
IIKVITRALRGARRLLKY

SEQ ID NO: 49 - protein, 17 aa, synthetic construct
  REGION 1..17: note = Synthetic
FLKRLLQKIKTCWNKIL

SEQ ID NO: 50 - protein, 17 aa, synthetic construct
  REGION 1..17: note = Synthetic
FLKRLLQKIKTCWNKIL

SEQ ID NO: 51 - protein, 17 aa, synthetic construct
  REGION 1..17: note = Synthetic
FLKRLLQKIKTCWNKIL

SEQ ID NO: 52 - protein, 17 aa, synthetic construct
  REGION 1..17: note = Synthetic
FLKRLLQKIKTCWNKIL

SEQ ID NO: 53 - protein, 17 aa, synthetic construct
  REGION 1..17: note = Synthetic
FLKRLLQKIKTCWNKIL

SEQ ID NO: 54 - protein, 17 aa, synthetic construct
  REGION 1..17: note = Synthetic
FLKRLLQKIKTCWNKIL

SEQ ID NO: 55 - protein, 17 aa, synthetic construct
  REGION 1..17: note = Synthetic
FLKRLLQKIKTCWNKIL

SEQ ID NO: 56 - protein, 17 aa, synthetic construct
  REGION 1..17: note = Synthetic
FLKRLLQKIKTCWNKIL

SEQ ID NO: 57 - protein, 17 aa, synthetic construct
  REGION 1..17: note = Synthetic
NGLFQKIKRWWKRIFDR

SEQ ID NO: 58 - protein, 14 aa, synthetic construct
  REGION 1..14: note = Synthetic
RRCLQLAHKVIRKL

SEQ ID NO: 59 - protein, 15 aa, synthetic construct
  REGION 1..15: note = Synthetic
FIKKLMTFIRKVLKT

SEQ ID NO: 60 - protein, 22 aa, synthetic construct
  REGION 1..22: note = Synthetic
FVKRLLDEIKTCWNKILRGAKK

SEQ ID NO: 61 - protein, 22 aa, synthetic construct
  REGION 1..22: note = Synthetic
FVKRLLDEIKTCWNKILRGAKK

SEQ ID NO: 62 - protein, 22 aa, synthetic construct
  REGION 1..22: note = Synthetic
FVKRLLDEIKTCWNKILRGAKK

SEQ ID NO: 63 - protein, 22 aa, synthetic construct
  REGION 1..22: note = Synthetic
FVKRLLDEIKTCWNKILRGAKK

SEQ ID NO: 64 - protein, 22 aa, synthetic construct
  REGION 1..22: note = Synthetic
FVKRLLDEIKTCWNKILRGAKK

SEQ ID NO: 65 - protein, 22 aa, synthetic construct
  REGION 1..22: note = Synthetic
FVKRLLDEIKTCWNKILRGAKK

SEQ ID NO: 66 - protein, 19 aa, synthetic construct
  REGION 1..19: note = Synthetic
FLKTLLQKIKTCWNKILRG

SEQ ID NO: 67 - protein, 14 aa, synthetic construct
  REGION 1..14: note = Synthetic
ITKAAKCAKKIYKR

SEQ ID NO: 68 - protein, 17 aa, synthetic construct
  REGION 1..17: note = Synthetic
TQAWTNFKKWFKNWFKK

SEQ ID NO: 69 - protein, 16 aa, synthetic construct
  REGION 1..16: note = Synthetic
KEVIKKFTKAMEKMKK

SEQ ID NO: 70 - protein, 16 aa, synthetic construct
  REGION 1..16: note = Synthetic
KEVIKKFTKAMEKMKK

SEQ ID NO: 71 - protein, 16 aa, synthetic construct
  REGION 1..16: note = Synthetic
KEVIKKFTKAMEKMKK

SEQ ID NO: 72 - protein, 16 aa, synthetic construct
  REGION 1..16: note = Synthetic
KEVIKKFTKAMEKMKK

SEQ ID NO: 73 - protein, 16 aa, synthetic construct
  REGION 1..16: note = Synthetic
KEVIKKFTKAMEKMKK

SEQ ID NO: 74 - protein, 16 aa, synthetic construct
  REGION 1..16: note = Synthetic
KEVIKKFTKAMEKMKK

SEQ ID NO: 75 - protein, 16 aa, synthetic construct
  REGION 1..16: note = Synthetic
KEVIKKFTKAMEKMKK

SEQ ID NO: 76 - protein, 17 aa, synthetic construct
  REGION 1..17: note = Synthetic
NGLFQKIKRWWKRIFEH

SEQ ID NO: 77 - protein, 17 aa, synthetic construct
  REGION 1..17: note = Synthetic
NGLFQKIKRWWKRIFEH

SEQ ID NO: 78 - protein, 17 aa, synthetic construct
  REGION 1..17: note = Synthetic
NGLFQKIKRWWKRIFEH

SEQ ID NO: 79 - protein, 17 aa, synthetic construct
  REGION 1..17: note = Synthetic
NGLFQKIKRWWKRIFEH

SEQ ID NO: 80 - protein, 17 aa, synthetic construct
  REGION 1..17: note = Synthetic
NGLFQKIKRWWKRIFEH

SEQ ID NO: 81 - protein, 14 aa, synthetic construct
  REGION 1..14: note = Synthetic
ITKASKCAKKIYKR

SEQ ID NO: 82 - protein, 15 aa, synthetic construct
  REGION 1..15: note = Synthetic
LWDKFQKFLKKVIRI

SEQ ID NO: 83 - protein, 19 aa, synthetic construct
  REGION 1..19: note = Synthetic
CNHMPNLLTRCLQRLKRLK

SEQ ID NO: 84 - protein, 16 aa, synthetic construct
  REGION 1..16: note = Synthetic
HSFYKCIDNLCKRFRR

SEQ ID NO: 85 - protein, 15 aa, synthetic construct
  REGION 1..15: note = Synthetic
MRRCLQLIDKVIRKL

SEQ ID NO: 86 - protein, 15 aa, synthetic construct
  REGION 1..15: note = Synthetic
MRRCLQLIDKVIRKL

SEQ ID NO: 87 - protein, 15 aa, synthetic construct
  REGION 1..15: note = Synthetic
MRRCLQLIDKVIRKL

SEQ ID NO: 88 - protein, 15 aa, synthetic construct
  REGION 1..15: note = Synthetic
MRRCLQLIDKVIRKL

SEQ ID NO: 89 - protein, 15 aa, synthetic construct
  REGION 1..15: note = Synthetic
MRRCLQLIDKVIRKL

SEQ ID NO: 90 - protein, 15 aa, synthetic construct
  REGION 1..15: note = Synthetic
MRRCLQLIDKVIRKL

SEQ ID NO: 91 - protein, 15 aa, synthetic construct
  REGION 1..15: note = Synthetic
MRRCLQLIDKVIRKL

SEQ ID NO: 92 - protein, 15 aa, synthetic construct
  REGION 1..15: note = Synthetic
MRRCLQLIDKVIRKL

SEQ ID NO: 93 - protein, 15 aa, synthetic construct
  REGION 1..15: note = Synthetic
MRRCLQLIDKVIRKL

SEQ ID NO: 94 - protein, 15 aa, synthetic construct
  REGION 1..15: note = Synthetic
MRRCLQLIDKVIRKL

SEQ ID NO: 95 - protein, 15 aa, synthetic construct
  REGION 1..15: note = Synthetic
MRRCLQFIDKVIRKL

SEQ ID NO: 96 - protein, 15 aa, synthetic construct
  REGION 1..15: note = Synthetic
MRKCLQLIDKVIRKL

SEQ ID NO: 97 - protein, 15 aa, synthetic construct
  REGION 1..15: note = Synthetic
MRRCLQLIEKVIRKL

SEQ ID NO: 98 - protein, 16 aa, synthetic construct
  REGION 1..16: note = Synthetic
KEFLKSFEKLIKKVIR

SEQ ID NO: 99 - protein, 18 aa, synthetic construct
  REGION 1..18: note = Synthetic
NLCKRACRTCCTHCRRVP

SEQ ID NO: 100 - protein, 14 aa, synthetic construct
  REGION 1..14: note = Synthetic
RRCLQLIDKVIRKL

SEQ ID NO: 101 - protein, 16 aa, synthetic construct
  REGION 1..16: note = Synthetic
YARRFSTLFRHLIKMI

SEQ ID NO: 102 - protein, 15 aa, synthetic construct
  REGION 1..15: note = Synthetic
REFLKSFAKLIKKVI

SEQ ID NO: 103 - protein, 15 aa, synthetic construct
  REGION 1..15: note = Synthetic
MRRCLQLIDKVMRKL

SEQ ID NO: 104 - protein, 15 aa, synthetic construct
  REGION 1..15: note = Synthetic
MRRCLQLIDKVVRKL

SEQ ID NO: 105 - protein, 15 aa, synthetic construct
  REGION 1..15: note = Synthetic
MRRCLQLIDKAIRKI

SEQ ID NO: 106 - protein, 15 aa, synthetic construct
  REGION 1..15: note = Synthetic
MRRCLQLIDKAIRKL

SEQ ID NO: 107 - protein, 15 aa, synthetic construct
  REGION 1..15: note = Synthetic
MRRCLQLIDKAIKKL

SEQ ID NO: 108 - protein, 15 aa, synthetic construct
  REGION 1..15: note = Synthetic
MRRCLQLVDKVIRKL

SEQ ID NO: 109 - protein, 15 aa, synthetic construct
  REGION 1..15: note = Synthetic
MRRCLQFVDKVIKRL

SEQ ID NO: 110 - protein, 15 aa, synthetic construct
  REGION 1..15: note = Synthetic
MRKCLQLVDKVIRKL

SEQ ID NO: 111 - protein, 14 aa, synthetic construct
  REGION 1..14: note = Synthetic
VKKAVKYLRTIMKS

SEQ ID NO: 112 - protein, 16 aa, synthetic construct
  REGION 1..16: note = Synthetic
KEFLKSFAKLIKQVIR

SEQ ID NO: 113 - protein, 16 aa, synthetic construct
  REGION 1..16: note = Synthetic
KEFLKSFAKLIKQVIR

SEQ ID NO: 114 - protein, 16 aa, synthetic construct
  REGION 1..16: note = Synthetic
KEFLKSFAKLIKQVIR

SEQ ID NO: 115 - protein, 16 aa, synthetic construct
  REGION 1..16: note = Synthetic
KEFLKSFAKLIKQVIR

SEQ ID NO: 116 - protein, 14 aa, synthetic construct
  REGION 1..14: note = Synthetic
LSHLLARIWKPYKK

SEQ ID NO: 117 - protein, 19 aa, synthetic construct
  REGION 1..19: note = Synthetic
LSIFAKCFHDLIKKFKKLG

SEQ ID NO: 118 - protein, 15 aa, synthetic construct
  REGION 1..15: note = Synthetic
MRRCLQLIDKVARKL

SEQ ID NO: 119 - protein, 18 aa, synthetic construct
  REGION 1..18: note = Synthetic
LLQKIKTCWNKILRGIKE

SEQ ID NO: 120 - protein, 18 aa, synthetic construct
  REGION 1..18: note = Synthetic
LLQKIKTCWNKILRGIKE

SEQ ID NO: 121 - protein, 18 aa, synthetic construct
  REGION 1..18: note = Synthetic
LLQKIKTCWNKILRGIKE

SEQ ID NO: 122 - protein, 14 aa, synthetic construct
  REGION 1..14: note = Synthetic
FRKLFRVYSNFLRG

SEQ ID NO: 123 - protein, 19 aa, synthetic construct
  REGION 1..19: note = Synthetic
FLKRLLREIKTCWNKILNS

SEQ ID NO: 124 - protein, 16 aa, synthetic construct
  REGION 1..16: note = Synthetic
IRRCLQLIDKAVRKLY

SEQ ID NO: 125 - protein, 15 aa, synthetic construct
  REGION 1..15: note = Synthetic
NFLSLIKKIFSVWKR

SEQ ID NO: 126 - protein, 14 aa, synthetic construct
  REGION 1..14: note = Synthetic
KIMRKIMTNLSRLC

SEQ ID NO: 127 - protein, 17 aa, synthetic construct
  REGION 1..17: note = Synthetic
KEFLKSFAKLIQKVIKS

SEQ ID NO: 128 - protein, 15 aa, synthetic construct
  REGION 1..15: note = Synthetic
FIKKLMTFIQKVLKN

SEQ ID NO: 129 - protein, 14 aa, synthetic construct
  REGION 1..14: note = Synthetic
RDAGRLLRSLKKLK

SEQ ID NO: 130 - protein, 17 aa, synthetic construct
  REGION 1..17: note = Synthetic
KNATTFIKKLMTFIRKA

SEQ ID NO: 131 - protein, 16 aa, synthetic construct
  REGION 1..16: note = Synthetic
GEMKNAMKKLWTRVRK

SEQ ID NO: 132 - protein, 17 aa, synthetic construct
  REGION 1..17: note = Synthetic
TQAWTNFKKWFKKWFKE

SEQ ID NO: 133 - protein, 17 aa, synthetic construct
  REGION 1..17: note = Synthetic
TQAWTNFKKWFKKWFKE

SEQ ID NO: 134 - protein, 19 aa, synthetic construct
  REGION 1..19: note = Synthetic
EVAQFVKDLLRHLKRLYRH

SEQ ID NO: 135 - protein, 14 aa, synthetic construct
  REGION 1..14: note = Synthetic
GAGRKVCAKLVKRL

SEQ ID NO: 136 - protein, 16 aa, synthetic construct
  REGION 1..16: note = Synthetic
LLQKIKTCWNKILRGS

SEQ ID NO: 137 - protein, 16 aa, synthetic construct
  REGION 1..16: note = Synthetic
LLQKIKTCWNKILRGS

SEQ ID NO: 138 - protein, 16 aa, synthetic construct
  REGION 1..16: note = Synthetic
LLQKIKTCWNKILRGS

SEQ ID NO: 139 - protein, 15 aa, synthetic construct
  REGION 1..15: note = Synthetic
NFIKRINDFLKKAKS

SEQ ID NO: 140 - protein, 23 aa, synthetic construct
  REGION 1..23: note = Synthetic
RFLHGYHRFMHSVGRVFSKWGES

SEQ ID NO: 141 - protein, 19 aa, synthetic construct
  REGION 1..19: note = Synthetic
LLQKIKTCWNKILRGAKEY

SEQ ID NO: 142 - protein, 19 aa, synthetic construct
  REGION 1..19: note = Synthetic
LLQKIKTCWNKILRGAKEY

SEQ ID NO: 143 - protein, 19 aa, synthetic construct
  REGION 1..19: note = Synthetic
LLQKIKTCWNKILRGAKEY

SEQ ID NO: 144 - protein, 19 aa, synthetic construct
  REGION 1..19: note = Synthetic
LLQKIKTCWNKILRGAKEY

SEQ ID NO: 145 - protein, 15 aa, synthetic construct
  REGION 1..15: note = Synthetic
FINKLMTFIRKALKP

SEQ ID NO: 146 - protein, 12 aa, synthetic construct
  REGION 1..12: note = Synthetic
LKDFLKSLKRIM

SEQ ID NO: 147 - protein, 13 aa, synthetic construct
  REGION 1..13: note = Synthetic
GRGIRPVGRFGRR

SEQ ID NO: 148 - protein, 16 aa, synthetic construct
  REGION 1..16: note = Synthetic
NGLWQRFLRWWNRLFH

SEQ ID NO: 149 - protein, 16 aa, synthetic construct
  REGION 1..16: note = Synthetic
NGLWQRFLRWWNRLFH

SEQ ID NO: 150 - protein, 16 aa, synthetic construct
  REGION 1..16: note = Synthetic
NGLWQRFLRWWNRLFH

SEQ ID NO: 151 - protein, 12 aa, synthetic construct
  REGION 1..12: note = Synthetic
SADKFWRRFARR

SEQ ID NO: 152 - protein, 16 aa, synthetic construct
  REGION 1..16: note = Synthetic
WSRWWSSCWRLWTRIY

SEQ ID NO: 153 - protein, 15 aa, synthetic construct
  REGION 1..15: note = Synthetic
YLKEALSRFKSWLKR

SEQ ID NO: 154 - protein, 14 aa, synthetic construct
  REGION 1..14: note = Synthetic
SPGRKLYNQIRRWP

SEQ ID NO: 155 - protein, 20 aa, synthetic construct
  REGION 1..20: note = Synthetic
KYGKSCEKAVHDLWHIIKKF

SEQ ID NO: 156 - protein, 14 aa, synthetic construct
  REGION 1..14: note = Synthetic
KVYSSVRKICKSCG

SEQ ID NO: 157 - protein, 15 aa, synthetic construct
  REGION 1..15: note = Synthetic
TQAWTNFKKWFKKMV

SEQ ID NO: 158 - protein, 14 aa, synthetic construct
  REGION 1..14: note = Synthetic
KIGASVRKICEKCR

SEQ ID NO: 159 - protein, 20 aa, synthetic construct
  REGION 1..20: note = Synthetic
GGGRDVLTRFKSWFKRVFGK

SEQ ID NO: 160 - protein, 14 aa, synthetic construct
  REGION 1..14: note = Synthetic
ITKASTCAKKIFKR

SEQ ID NO: 161 - protein, 17 aa, synthetic construct
  REGION 1..17: note = Synthetic
FIEKLMTFIRKALKNAR

SEQ ID NO: 162 - protein, 14 aa, synthetic construct
  REGION 1..14: note = Synthetic
AYYKRCARLLTRLA

SEQ ID NO: 163 - protein, 14 aa, synthetic construct
  REGION 1..14: note = Synthetic
AYYKRCARLLTRLA

SEQ ID NO: 164 - protein, 15 aa, synthetic construct
  REGION 1..15: note = Synthetic
SQLRNLIRSVRTVMR

SEQ ID NO: 165 - protein, 17 aa, synthetic construct
  REGION 1..17: note = Synthetic
KNATKFIEKLMTFIRRA

SEQ ID NO: 166 - protein, 15 aa, synthetic construct
  REGION 1..15: note = Synthetic
YASRGIRPVGRFGRR

SEQ ID NO: 167 - protein, 15 aa, synthetic construct
  REGION 1..15: note = Synthetic
HLKRYYGRILHYLKA

SEQ ID NO: 168 - protein, 17 aa, synthetic construct
  REGION 1..17: note = Synthetic
TIPAYYKRCARLLTRLA

SEQ ID NO: 169 - protein, 17 aa, synthetic construct
  REGION 1..17: note = Synthetic
TIPAYYKRCARLLTRLA

SEQ ID NO: 170 - protein, 17 aa, synthetic construct
  REGION 1..17: note = Synthetic
TIPAYYKRCARLLTRLA

SEQ ID NO: 171 - protein, 12 aa, synthetic construct
  REGION 1..12: note = Synthetic
VGRVHRLLRKGN

SEQ ID NO: 172 - protein, 14 aa, synthetic construct
  REGION 1..14: note = Synthetic
KVAASVRKICEKCR

SEQ ID NO: 173 - protein, 18 aa, synthetic construct
  REGION 1..18: note = Synthetic
IRKIAQLLNKVADAAKKG

SEQ ID NO: 174 - protein, 15 aa, synthetic construct
  REGION 1..15: note = Synthetic
GGFCKRFAGGAKKCH

SEQ ID NO: 175 - protein, 13 aa, synthetic construct
  REGION 1..13: note = Synthetic
MRFMRRLVRNLQY

SEQ ID NO: 176 - protein, 12 aa, synthetic construct
  REGION 1..12: note = Synthetic
LPGFIGKICRKI

SEQ ID NO: 177 - protein, 14 aa, synthetic construct
  REGION 1..14: note = Synthetic
ILANIHKIIKAYQR

SEQ ID NO: 178 - protein, 12 aa, synthetic construct
  REGION 1..12: note = Synthetic
IFHGCKKVARVL

SEQ ID NO: 179 - protein, 23 aa, synthetic construct
  REGION 1..23: note = Synthetic
LAKRYGGFMKRYGGFMKKMDELY

SEQ ID NO: 180 - protein, 15 aa, synthetic construct
  REGION 1..15: note = Synthetic
QAIRCMQSLFRTVKR

SEQ ID NO: 181 - protein, 14 aa, synthetic construct
  REGION 1..14: note = Synthetic
WRRALRAAAGPLAR

SEQ ID NO: 182 - protein, 14 aa, synthetic construct
  REGION 1..14: note = Synthetic
IKRIIRDVKEIVRA

SEQ ID NO: 183 - protein, 16 aa, synthetic construct
  REGION 1..16: note = Synthetic
KEFLKSFEKLIQKVIR

SEQ ID NO: 184 - protein, 16 aa, synthetic construct
  REGION 1..16: note = Synthetic
EKVSNWWKRIWEKIKN

SEQ ID NO: 185 - protein, 16 aa, synthetic construct
  REGION 1..16: note = Synthetic
EKVSNWWKRIWEKIKN

SEQ ID NO: 186 - protein, 23 aa, synthetic construct
  REGION 1..23: note = Synthetic
IPSCVTRALSRAARSIWDALKKI

SEQ ID NO: 187 - protein, 14 aa, synthetic construct
  REGION 1..14: note = Synthetic
ARKLYTIMNSFCRR

SEQ ID NO: 188 - protein, 29 aa, synthetic construct
  REGION 1..29: note = Synthetic
GKLMELGHKIMKNLENTVKEIIKYLKSLF

SEQ ID NO: 189 - protein, 20 aa, synthetic construct
  REGION 1..20: note = Synthetic
KPIKEFLERLKSLIQKMIHQ

SEQ ID NO: 190 - protein, 20 aa, synthetic construct
  REGION 1..20: note = Synthetic
KPIKEFLERLKSLIQKMIHQ

SEQ ID NO: 191 - protein, 20 aa, synthetic construct
  REGION 1..20: note = Synthetic
KPIKEFLERLKSLIQKMIHQ

SEQ ID NO: 192 - protein, 15 aa, synthetic construct
  REGION 1..15: note = Synthetic
KEFLKSFAKLIQKVI

SEQ ID NO: 193 - protein, 15 aa, synthetic construct
  REGION 1..15: note = Synthetic
KEFLKSFAKLIQKVI

SEQ ID NO: 194 - protein, 12 aa, synthetic construct
  REGION 1..12: note = Synthetic
RRLKGVAKKGLG

SEQ ID NO: 195 - protein, 17 aa, synthetic construct
  REGION 1..17: note = Synthetic
FLKRLLQEIKTCWNKIL

SEQ ID NO: 196 - protein, 17 aa, synthetic construct
  REGION 1..17: note = Synthetic
FLKRLLQEIKTCWNKIL

SEQ ID NO: 197 - protein, 17 aa, synthetic construct
  REGION 1..17: note = Synthetic
FLKRLLQEIKTCWNKIL

SEQ ID NO: 198 - protein, 17 aa, synthetic construct
  REGION 1..17: note = Synthetic
FLKRLLQEIKTCWNKIL

SEQ ID NO: 199 - protein, 17 aa, synthetic construct
  REGION 1..17: note = Synthetic
FLKRLLQEIKTCWNKIL

SEQ ID NO: 200 - protein, 17 aa, synthetic construct
  REGION 1..17: note = Synthetic
FLKRLLQEIKTCWNKIL

SEQ ID NO: 201 - protein, 17 aa, synthetic construct
  REGION 1..17: note = Synthetic
FLKRLLQEIKTCWNKIL

SEQ ID NO: 202 - protein, 20 aa, synthetic construct
  REGION 1..20: note = Synthetic
KPLKEFLERLKSLIQKMIHQ

SEQ ID NO: 203 - protein, 16 aa, synthetic construct
  REGION 1..16: note = Synthetic
KEFLKSFANLIKQVIR

SEQ ID NO: 204 - protein, 37 aa, synthetic construct
  REGION 1..37: note = Synthetic
GKLMELGHKIMRNLENTVKETIKYLKSLFSHASEVVK

SEQ ID NO: 205 - protein, 12 aa, synthetic construct
  REGION 1..12: note = Synthetic
HKMKKLLRYLNY

SEQ ID NO: 206 - protein, 17 aa, synthetic construct
  REGION 1..17: note = Synthetic
KSFSSICKELCKLCQRC

SEQ ID NO: 207 - protein, 17 aa, synthetic construct
  REGION 1..17: note = Synthetic
KSFSSICKELCKLCQRC

SEQ ID NO: 208 - protein, 16 aa, synthetic construct
  REGION 1..16: note = Synthetic
KEFLQSFGKLINKVIR

SEQ ID NO: 209 - protein, 21 aa, synthetic construct
  REGION 1..21: note = Synthetic
ILANFQRFLETAYRALRHLAR

SEQ ID NO: 210 - protein, 16 aa, synthetic construct
  REGION 1..16: note = Synthetic
KEFLKSFAKLIQQVIR

SEQ ID NO: 211 - protein, 16 aa, synthetic construct
  REGION 1..16: note = Synthetic
KEFLKSFAKLIQQVIR

SEQ ID NO: 212 - protein, 16 aa, synthetic construct
  REGION 1..16: note = Synthetic
KEFLKSFAKLIQQVIR

SEQ ID NO: 213 - protein, 16 aa, synthetic construct
  REGION 1..16: note = Synthetic
KEFLKSFAKLIQQVIR

SEQ ID NO: 214 - protein, 14 aa, synthetic construct
  REGION 1..14: note = Synthetic
KEFLQSFSKLMKKV

SEQ ID NO: 215 - protein, 18 aa, synthetic construct
  REGION 1..18: note = Synthetic
KPLHTMVNHISRFATKMT

SEQ ID NO: 216 - protein, 15 aa, synthetic construct
  REGION 1..15: note = Synthetic
GGKLFDVLKKIIKVI

SEQ ID NO: 217 - protein, 16 aa, synthetic construct
  REGION 1..16: note = Synthetic
KEFLQSFAKLIKQVIR

SEQ ID NO: 218 - protein, 18 aa, synthetic construct
  REGION 1..18: note = Synthetic
LLQKIKTCWNKILRGITE

SEQ ID NO: 219 - protein, 18 aa, synthetic construct
  REGION 1..18: note = Synthetic
RIRDVFSSIFRNIFNLFR

SEQ ID NO: 220 - protein, 18 aa, synthetic construct
  REGION 1..18: note = Synthetic
QKIAQLVKKWIKTVLEAR

SEQ ID NO: 221 - protein, 38 aa, synthetic construct
  REGION 1..38: note = Synthetic
GKLMELGHKIMRNLENTVKETIKYLKSLFSHAFEVVKT

SEQ ID NO: 222 - protein, 21 aa, synthetic construct
  REGION 1..21: note = Synthetic
EVTRLAKDLLQQLRKGVRQGK

SEQ ID NO: 223 - protein, 21 aa, synthetic construct
  REGION 1..21: note = Synthetic
EVTRLAKDLLQQLRKGVRQGK

SEQ ID NO: 224 - protein, 12 aa, synthetic construct
  REGION 1..12: note = Synthetic
LPRLLRTYISRI

SEQ ID NO: 225 - protein, 12 aa, synthetic construct
  REGION 1..12: note = Synthetic
LPRLLRTYISRI

SEQ ID NO: 226 - protein, 17 aa, synthetic construct
  REGION 1..17: note = Synthetic
LKKLNQIVQKFHQLLQG

SEQ ID NO: 227 - protein, 16 aa, synthetic construct
  REGION 1..16: note = Synthetic
DFKNLIRKCVDVARKV

SEQ ID NO: 228 - protein, 19 aa, synthetic construct
  REGION 1..19: note = Synthetic
NATTYLKEALSRFKSWLKR

SEQ ID NO: 229 - protein, 19 aa, synthetic construct
  REGION 1..19: note = Synthetic
NATTYLKEALSRFKSWLKR

SEQ ID NO: 230 - protein, 19 aa, synthetic construct
  REGION 1..19: note = Synthetic
NATTYLKEALSRFKSWLKR

SEQ ID NO: 231 - protein, 16 aa, synthetic construct
  REGION 1..16: note = Synthetic
KWVQKVVQAFLKRAEK

SEQ ID NO: 232 - protein, 14 aa, synthetic construct
  REGION 1..14: note = Synthetic
ARKMVTRALRALQN

SEQ ID NO: 233 - protein, 17 aa, synthetic construct
  REGION 1..17: note = Synthetic
KEFLERFKSLLQKMIHR

SEQ ID NO: 234 - protein, 13 aa, synthetic construct
  REGION 1..13: note = Synthetic
AKKALAKAKTVLK

SEQ ID NO: 235 - protein, 17 aa, synthetic construct
  REGION 1..17: note = Synthetic
NGLWQRFLRWWNRLFTG

SEQ ID NO: 236 - protein, 17 aa, synthetic construct
  REGION 1..17: note = Synthetic
NGLWQRFLRWWNRLFTG

SEQ ID NO: 237 - protein, 17 aa, synthetic construct
  REGION 1..17: note = Synthetic
NGLWQRFLRWWNRLFTG

SEQ ID NO: 238 - protein, 21 aa, synthetic construct
  REGION 1..21: note = Synthetic
ATKLSDAMQRIKTMFRNWYQK

SEQ ID NO: 239 - protein, 13 aa, synthetic construct
  REGION 1..13: note = Synthetic
CITFCNKCCRKCL

SEQ ID NO: 240 - protein, 19 aa, synthetic construct
  REGION 1..19: note = Synthetic
CCDLIRKCWHDIKECWKRC

SEQ ID NO: 241 - protein, 12 aa, synthetic construct
  REGION 1..12: note = Synthetic
KLFRIYSNFLRG

SEQ ID NO: 242 - protein, 12 aa, synthetic construct
  REGION 1..12: note = Synthetic
KLFRIYSNFLRG

SEQ ID NO: 243 - protein, 12 aa, synthetic construct
  REGION 1..12: note = Synthetic
KLFRIYSNFLRG

SEQ ID NO: 244 - protein, 12 aa, synthetic construct
  REGION 1..12: note = Synthetic
KLFRIYSNFLRG

SEQ ID NO: 245 - protein, 12 aa, synthetic construct
  REGION 1..12: note = Synthetic
KLFRIYSNFLRG

SEQ ID NO: 246 - protein, 12 aa, synthetic construct
  REGION 1..12: note = Synthetic
KLFRIYSNFLRG

SEQ ID NO: 247 - protein, 12 aa, synthetic construct
  REGION 1..12: note = Synthetic
KLFRIYSNFLRG

SEQ ID NO: 248 - protein, 16 aa, synthetic construct
  REGION 1..16: note = Synthetic
EKFESCMKKCSKICNK

SEQ ID NO: 249 - protein, 12 aa, synthetic construct
  REGION 1..12: note = Synthetic
KLFRVYSNFLRG

SEQ ID NO: 250 - protein, 12 aa, synthetic construct
  REGION 1..12: note = Synthetic
KLFRVYSNFLRG

SEQ ID NO: 251 - protein, 12 aa, synthetic construct
  REGION 1..12: note = Synthetic
KLFRVYSNFLRG

SEQ ID NO: 252 - protein, 12 aa, synthetic construct
  REGION 1..12: note = Synthetic
KLFRVYSNFLRG

SEQ ID NO: 253 - protein, 15 aa, synthetic construct
  REGION 1..15: note = Synthetic
RKLYHRVGTCIQNIF

SEQ ID NO: 254 - protein, 12 aa, synthetic construct
  REGION 1..12: note = Synthetic
FKSLKGYWSKFT

SEQ ID NO: 255 - protein, 17 aa, synthetic construct
  REGION 1..17: note = Synthetic
ISSLRSCWNKFEKIISR

SEQ ID NO: 256 - protein, 21 aa, synthetic construct
  REGION 1..21: note = Synthetic
VNHYHRGCEKITRCARDAARY

SEQ ID NO: 257 - protein, 17 aa, synthetic construct
  REGION 1..17: note = Synthetic
ISSLRSCWNKFEKLISR

SEQ ID NO: 258 - protein, 20 aa, synthetic construct
  REGION 1..20: note = Synthetic
CCRKVVKYWTHCCQEGLRCT

SEQ ID NO: 259 - protein, 17 aa, synthetic construct
  REGION 1..17: note = Synthetic
GRTFRSCARTAFRTAKL

SEQ ID NO: 260 - protein, 12 aa, synthetic construct
  REGION 1..12: note = Synthetic
KLFRVYANFLRG

SEQ ID NO: 261 - protein, 12 aa, synthetic construct
  REGION 1..12: note = Synthetic
YGRGCRRCCSYL

SEQ ID NO: 262 - protein, 19 aa, synthetic construct
  REGION 1..19: note = Synthetic
FLKRLLQEIKTCWNKILSG

SEQ ID NO: 263 - protein, 19 aa, synthetic construct
  REGION 1..19: note = Synthetic
FLKRLLQEIKTCWNKILSG

SEQ ID NO: 264 - protein, 19 aa, synthetic construct
  REGION 1..19: note = Synthetic
FLKRLLQEIKTCWNKILSG

SEQ ID NO: 265 - protein, 14 aa, synthetic construct
  REGION 1..14: note = Synthetic
SVARHAARDLRRWM

SEQ ID NO: 266 - protein, 18 aa, synthetic construct
  REGION 1..18: note = Synthetic
LLQKIKTCWNKILRDAKE

SEQ ID NO: 267 - protein, 17 aa, synthetic construct
  REGION 1..17: note = Synthetic
WAKYHAAVRHYVNLITR

SEQ ID NO: 268 - protein, 17 aa, synthetic construct
  REGION 1..17: note = Synthetic
WAKYHAAVRHYVNLITR

SEQ ID NO: 269 - protein, 15 aa, synthetic construct
  REGION 1..15: note = Synthetic
EEVFKKFKKVAKSFG

SEQ ID NO: 270 - protein, 14 aa, synthetic construct
  REGION 1..14: note = Synthetic
FGRAGAKFIRFGRS

SEQ ID NO: 271 - protein, 15 aa, synthetic construct
  REGION 1..15: note = Synthetic
DLKTLFTTIWKFIKK

SEQ ID NO: 272 - protein, 13 aa, synthetic construct
  REGION 1..13: note = Synthetic
KKCCGGCPRLCEK

SEQ ID NO: 273 - protein, 18 aa, synthetic construct
  REGION 1..18: note = Synthetic
KQVANPYRRGCGTIERCR

SEQ ID NO: 274 - protein, 14 aa, synthetic construct
  REGION 1..14: note = Synthetic
SDAKKLMRDLKRML

SEQ ID NO: 275 - protein, 15 aa, synthetic construct
  REGION 1..15: note = Synthetic
NKGMNEFKKILRTLA

SEQ ID NO: 276 - protein, 13 aa, synthetic construct
  REGION 1..13: note = Synthetic
FTKIKDALKKISQ

SEQ ID NO: 277 - protein, 12 aa, synthetic construct
  REGION 1..12: note = Synthetic
VRKIYQTAKHLP

SEQ ID NO: 278 - protein, 15 aa, synthetic construct
  REGION 1..15: note = Synthetic
VHNYSRGCSRITRCR

SEQ ID NO: 279 - protein, 15 aa, synthetic construct
  REGION 1..15: note = Synthetic
KIKRIVQKILESAER

SEQ ID NO: 280 - protein, 13 aa, synthetic construct
  REGION 1..13: note = Synthetic
ARMATKLGRKVLN

SEQ ID NO: 281 - protein, 15 aa, synthetic construct
  REGION 1..15: note = Synthetic
KTLVNLWSKLAQRIF

SEQ ID NO: 282 - protein, 35 aa, synthetic construct
  REGION 1..35: note = Synthetic
QALAKAGKGMHGGVPGGKQFIENGSEFAQKLLKKF

SEQ ID NO: 283 - protein, 18 aa, synthetic construct
  REGION 1..18: note = Synthetic
NPYRRGCSAITHCYRYAR

SEQ ID NO: 284 - protein, 17 aa, synthetic construct
  REGION 1..17: note = Synthetic
RVKQVLNQLLKNMDHLK

SEQ ID NO: 285 - protein, 14 aa, synthetic construct
  REGION 1..14: note = Synthetic
VSSFLEHVKRCVRH

SEQ ID NO: 286 - protein, 17 aa, synthetic construct
  REGION 1..17: note = Synthetic
LRTVTELLKKVVDAAKK

SEQ ID NO: 287 - protein, 14 aa, synthetic construct
  REGION 1..14: note = Synthetic
AKALFNKLTEYLKK

SEQ ID NO: 288 - protein, 20 aa, synthetic construct
  REGION 1..20: note = Synthetic
EVAQFVKDLLRHLRKLFHQG

SEQ ID NO: 289 - protein, 20 aa, synthetic construct
  REGION 1..20: note = Synthetic
EVAQFVKDLLRHLRKLFHQG

SEQ ID NO: 290 - protein, 20 aa, synthetic construct
  REGION 1..20: note = Synthetic
EVAQFVKDLLRHLRKLFHQG

SEQ ID NO: 291 - protein, 16 aa, synthetic construct
  REGION 1..16: note = Synthetic
KNLLKMLSKAVDALKS

SEQ ID NO: 292 - protein, 14 aa, synthetic construct
  REGION 1..14: note = Synthetic
LRRYFHRIDNFLKE

SEQ ID NO: 293 - protein, 12 aa, synthetic construct
  REGION 1..12: note = Synthetic
SRCYRSLYKCVA

SEQ ID NO: 294 - protein, 22 aa, synthetic construct
  REGION 1..22: note = Synthetic
QWLTSCWSTLMRLIHQMAGRYR

SEQ ID NO: 295 - protein, 14 aa, synthetic construct
  REGION 1..14: note = Synthetic
ASVRKMCEKCRTIR

SEQ ID NO: 296 - protein, 13 aa, synthetic construct
  REGION 1..13: note = Synthetic
CLKNAARGIRGLN

SEQ ID NO: 297 - protein, 13 aa, synthetic construct
  REGION 1..13: note = Synthetic
CLKNAARGIKGLN

SEQ ID NO: 298 - protein, 15 aa, synthetic construct
  REGION 1..15: note = Synthetic
EVAQFIKDLLRHLKK

SEQ ID NO: 299 - protein, 13 aa, synthetic construct
  REGION 1..13: note = Synthetic
GGAIGKFMNVLRR

SEQ ID NO: 300 - protein, 15 aa, synthetic construct
  REGION 1..15: note = Synthetic
ANEYRRGCSKITRCK

SEQ ID NO: 301 - protein, 13 aa, synthetic construct
  REGION 1..13: note = Synthetic
RSFRNGVGSGVKK

SEQ ID NO: 302 - protein, 14 aa, synthetic construct
  REGION 1..14: note = Synthetic
TILRKARNLLNHGI

SEQ ID NO: 303 - protein, 18 aa, synthetic construct
  REGION 1..18: note = Synthetic
AVWKDFLKNIGKAAGKAV

SEQ ID NO: 304 - protein, 27 aa, synthetic construct
  REGION 1..27: note = Synthetic
KHAHSMITSMLSFVNSVVNFGRSFVRN

SEQ ID NO: 305 - protein, 14 aa, synthetic construct
  REGION 1..14: note = Synthetic
VKKMLKDVPKLATS

SEQ ID NO: 306 - protein, 12 aa, synthetic construct
  REGION 1..12: note = Synthetic
RACQQFLKRCHL

SEQ ID NO: 307 - protein, 12 aa, synthetic construct
  REGION 1..12: note = Synthetic
NVLRALRRLGSS

SEQ ID NO: 308 - protein, 20 aa, synthetic construct
  REGION 1..20: note = Synthetic
GKNWSEFVRSMLRAMSKVAA

SEQ ID NO: 309 - protein, 18 aa, synthetic construct
  REGION 1..18: note = Synthetic
ELITFMKNLLDHLRRIYR

SEQ ID NO: 310 - protein, 16 aa, synthetic construct
  REGION 1..16: note = Synthetic
ICKSFQSLVHRFGHVT

SEQ ID NO: 311 - protein, 12 aa, synthetic construct
  REGION 1..12: note = Synthetic
LKCCKSMCGKVC

SEQ ID NO: 312 - protein, 12 aa, synthetic construct
  REGION 1..12: note = Synthetic
KRMEYIAKKLDK

SEQ ID NO: 313 - protein, 17 aa, synthetic construct
  REGION 1..17: note = Synthetic
ASVVQQIFQRIIRVLRS

SEQ ID NO: 314 - protein, 13 aa, synthetic construct
  REGION 1..13: note = Synthetic
KRLRKMGGDLNSL

SEQ ID NO: 315 - protein, 18 aa, synthetic construct
  REGION 1..18: note = Synthetic
KSYVEKLTKALSTIRQCI

SEQ ID NO: 316 - protein, 12 aa, synthetic construct
  REGION 1..12: note = Synthetic
RLGRQLHNIVDK

SEQ ID NO: 317 - protein, 15 aa, synthetic construct
  REGION 1..15: note = Synthetic
SQLTNLIRSVRTVMR

SEQ ID NO: 318 - protein, 14 aa, synthetic construct
  REGION 1..14: note = Synthetic
LKDLGSRARAWLRS

SEQ ID NO: 319 - protein, 13 aa, synthetic construct
  REGION 1..13: note = Synthetic
RSFRNGVGTGMKK

SEQ ID NO: 320 - protein, 13 aa, synthetic construct
  REGION 1..13: note = Synthetic
RSFRNGVGTGMKK

SEQ ID NO: 321 - protein, 14 aa, synthetic construct
  REGION 1..14: note = Synthetic
YRRGCSVITHCYRQ

SEQ ID NO: 322 - protein, 13 aa, synthetic construct
  REGION 1..13: note = Synthetic
CLKGIARGIHNLN

SEQ ID NO: 323 - protein, 12 aa, synthetic construct
  REGION 1..12: note = Synthetic
RFGRNAWGPWSK

SEQ ID NO: 324 - protein, 15 aa, synthetic construct
  REGION 1..15: note = Synthetic
ANPYSRGCSKIARCR

SEQ ID NO: 325 - protein, 12 aa, synthetic construct
  REGION 1..12: note = Synthetic
ILHSFLKVLHHL

SEQ ID NO: 326 - protein, 15 aa, synthetic construct
  REGION 1..15: note = Synthetic
IKCAKKIARDAHGLT

SEQ ID NO: 327 - protein, 16 aa, synthetic construct
  REGION 1..16: note = Synthetic
VLKLWNSVLKHICNLS

SEQ ID NO: 328 - protein, 17 aa, synthetic construct
  REGION 1..17: note = Synthetic
LRQLRSFMQDVFRSLRC

SEQ ID NO: 329 - protein, 12 aa, synthetic construct
  REGION 1..12: note = Synthetic
GRHLLNELKKWP

SEQ ID NO: 330 - protein, 14 aa, synthetic construct
  REGION 1..14: note = Synthetic
NCLKGIARGIHNLN

SEQ ID NO: 331 - protein, 12 aa, synthetic construct
  REGION 1..12: note = Synthetic
WRRVMHCFSYCW

SEQ ID NO: 332 - protein, 13 aa, synthetic construct
  REGION 1..13: note = Synthetic
RSFRNGVGSGAKK

SEQ ID NO: 333 - protein, 21 aa, synthetic construct
  REGION 1..21: note = Synthetic
DLTRALHDLVKALKKAYRTLD

SEQ ID NO: 334 - protein, 12 aa, synthetic construct
  REGION 1..12: note = Synthetic
KRLRKMGGDLNS

SEQ ID NO: 335 - protein, 17 aa, synthetic construct
  REGION 1..17: note = Synthetic
KNATTFIEKLMTFIRKA

SEQ ID NO: 336 - protein, 15 aa, synthetic construct
  REGION 1..15: note = Synthetic
EVIQLVKNLLNHLRR

SEQ ID NO: 337 - protein, 18 aa, synthetic construct
  REGION 1..18: note = Synthetic
LKEFLERLKSLIQKMIHQ

SEQ ID NO: 338 - protein, 15 aa, synthetic construct
  REGION 1..15: note = Synthetic
VNEYSRGCSKIHRCR

SEQ ID NO: 339 - protein, 15 aa, synthetic construct
  REGION 1..15: note = Synthetic
VNEYSRGCSKIHRCR

SEQ ID NO: 340 - protein, 15 aa, synthetic construct
  REGION 1..15: note = Synthetic
VNEYSRGCSKIHRCR

SEQ ID NO: 341 - protein, 21 aa, synthetic construct
  REGION 1..21: note = Synthetic
CGQFTRLCRHFVHELKQALTS

SEQ ID NO: 342 - protein, 21 aa, synthetic construct
  REGION 1..21: note = Synthetic
CGQFTRLCRHFVHELKQALTS

SEQ ID NO: 343 - protein, 12 aa, synthetic construct
  REGION 1..12: note = Synthetic
DKAKKAIERIKQ

SEQ ID NO: 344 - protein, 16 aa, synthetic construct
  REGION 1..16: note = Synthetic
EKISDWWKRIWEKIKN

SEQ ID NO: 345 - protein, 22 aa, synthetic construct
  REGION 1..22: note = Synthetic
LENMKTVIKSGVEKLKNFLQRG

SEQ ID NO: 346 - protein, 16 aa, synthetic construct
  REGION 1..16: note = Synthetic
NATRFMEKLMTFVRKA

SEQ ID NO: 347 - protein, 14 aa, synthetic construct
  REGION 1..14: note = Synthetic
RMATKAGRRVINAR

SEQ ID NO: 348 - protein, 19 aa, synthetic construct
  REGION 1..19: note = Synthetic
ILANFQRFLETAYRALRHL

SEQ ID NO: 349 - protein, 12 aa, synthetic construct
  REGION 1..12: note = Synthetic
RFGRSAWGSWSK

SEQ ID NO: 350 - protein, 16 aa, synthetic construct
  REGION 1..16: note = Synthetic
THVKQAINKMLTKISS

SEQ ID NO: 351 - protein, 16 aa, synthetic construct
  REGION 1..16: note = Synthetic
RELPKVCRNIFSRVSL

SEQ ID NO: 352 - protein, 14 aa, synthetic construct
  REGION 1..14: note = Synthetic
ASVRKICSRCVALK

SEQ ID NO: 353 - protein, 14 aa, synthetic construct
  REGION 1..14: note = Synthetic
LSRYAKLANRLANP

SEQ ID NO: 354 - protein, 42 aa, synthetic construct
  REGION 1..42: note = Synthetic
DILRECAKGLEVRVAENQHLANETVEYFFKKLWRGVKKVVKK

SEQ ID NO: 355 - protein, 25 aa, synthetic construct
  REGION 1..25: note = Synthetic
YGCCRKGYNGCKRCCSYAGEAIDKV

SEQ ID NO: 356 - protein, 25 aa, synthetic construct
  REGION 1..25: note = Synthetic
YGCCRKGYNGCKRCCSYAGEAIDKV

SEQ ID NO: 357 - protein, 18 aa, synthetic construct
  REGION 1..18: note = Synthetic
QEFLNSFSKLMQKVIKIH

SEQ ID NO: 358 - protein, 12 aa, synthetic construct
  REGION 1..12: note = Synthetic
RCLSPMNHLCHK

SEQ ID NO: 359 - protein, 12 aa, synthetic construct
  REGION 1..12: note = Synthetic
RCLSPMNHLCHK

SEQ ID NO: 360 - protein, 17 aa, synthetic construct
  REGION 1..17: note = Synthetic
AFNAVKRLLDQARQLGR

SEQ ID NO: 361 - protein, 17 aa, synthetic construct
  REGION 1..17: note = Synthetic
AAKNALQKFIEEMKKIK

SEQ ID NO: 362 - protein, 20 aa, synthetic construct
  REGION 1..20: note = Synthetic
EVKKIWATIIERLYKLWRDW

SEQ ID NO: 363 - protein, 12 aa, synthetic construct
  REGION 1..12: note = Synthetic
GLKTAYRRIYGI

SEQ ID NO: 364 - protein, 12 aa, synthetic construct
  REGION 1..12: note = Synthetic
GLKTAYKRIYGI

SEQ ID NO: 365 - protein, 12 aa, synthetic construct
  REGION 1..12: note = Synthetic
GLKTAYKRIYGI

SEQ ID NO: 366 - protein, 14 aa, synthetic construct
  REGION 1..14: note = Synthetic
LKDFLENLKRIMQK

SEQ ID NO: 367 - protein, 17 aa, synthetic construct
  REGION 1..17: note = Synthetic
QVLHQVQKLANELLRKL

SEQ ID NO: 368 - protein, 12 aa, synthetic construct
  REGION 1..12: note = Synthetic
CHRACGSCCAKC

SEQ ID NO: 369 - protein, 29 aa, synthetic construct
  REGION 1..29: note = Synthetic
QCLANGSKCYSHDVCCTKRCHNYAKKCVT

SEQ ID NO: 370 - protein, 18 aa, synthetic construct
  REGION 1..18: note = Synthetic
KSATTFIEKLTTFIRKAS

SEQ ID NO: 371 - protein, 23 aa, synthetic construct
  REGION 1..23: note = Synthetic
KGYYKGCKKCCSYAGQAMDKVTE

SEQ ID NO: 372 - protein, 20 aa, synthetic construct
  REGION 1..20: note = Synthetic
ILANFQRFLETAYRALRHLA

SEQ ID NO: 373 - protein, 16 aa, synthetic construct
  REGION 1..16: note = Synthetic
EGWSTLMRTVHSVIKR

SEQ ID NO: 374 - protein, 15 aa, synthetic construct
  REGION 1..15: note = Synthetic
DLSSVAKTLIHRLHK

SEQ ID NO: 375 - protein, 25 aa, synthetic construct
  REGION 1..25: note = Synthetic
YGCCRKGYNGCKRCCSYAGEAMDKV

SEQ ID NO: 376 - protein, 25 aa, synthetic construct
  REGION 1..25: note = Synthetic
YGCCRKGYNGCKRCCSYAGEAMDKV

SEQ ID NO: 377 - protein, 25 aa, synthetic construct
  REGION 1..25: note = Synthetic
YGCCRKGYNGCKRCCSYAGEAMDKV

SEQ ID NO: 378 - protein, 12 aa, synthetic construct
  REGION 1..12: note = Synthetic
VRKIYQAAKYLP

SEQ ID NO: 379 - protein, 16 aa, synthetic construct
  REGION 1..16: note = Synthetic
ASQLLKVLHKIWTQVP

SEQ ID NO: 380 - protein, 27 aa, synthetic construct
  REGION 1..27: note = Synthetic
VALVTGAGRGIGRSIAKTLAKSVSHVL

SEQ ID NO: 381 - protein, 17 aa, synthetic construct
  REGION 1..17: note = Synthetic
RWSSGFHKVFAEGTKLI

SEQ ID NO: 382 - protein, 17 aa, synthetic construct
  REGION 1..17: note = Synthetic
KEFLERLKSLIQRMIHQ

SEQ ID NO: 383 - protein, 15 aa, synthetic construct
  REGION 1..15: note = Synthetic
KLSNMLRNLMHLVNQ

SEQ ID NO: 384 - protein, 16 aa, synthetic construct
  REGION 1..16: note = Synthetic
RVIKCIDHICQYARNL

SEQ ID NO: 385 - protein, 16 aa, synthetic construct
  REGION 1..16: note = Synthetic
RVIKCIDHICQYARNL

SEQ ID NO: 386 - protein, 17 aa, synthetic construct
  REGION 1..17: note = Synthetic
KEFLERFKSLLQKMIHQ

SEQ ID NO: 387 - protein, 17 aa, synthetic construct
  REGION 1..17: note = Synthetic
KEFLERFKSLLQKMIHQ

SEQ ID NO: 388 - protein, 17 aa, synthetic construct
  REGION 1..17: note = Synthetic
KEFLERFKSLLQKMIHQ

SEQ ID NO: 389 - protein, 17 aa, synthetic construct
  REGION 1..17: note = Synthetic
KEFLERFKSLLQKMIHQ

SEQ ID NO: 390 - protein, 17 aa, synthetic construct
  REGION 1..17: note = Synthetic
KEFLERFKSLLQKMIHQ

SEQ ID NO: 391 - protein, 17 aa, synthetic construct
  REGION 1..17: note = Synthetic
KEFLERFKSLLQKMIHQ

SEQ ID NO: 392 - protein, 17 aa, synthetic construct
  REGION 1..17: note = Synthetic
KEFLERFKSLLQKMIHQ

SEQ ID NO: 393 - protein, 17 aa, synthetic construct
  REGION 1..17: note = Synthetic
KEFLERFKSLLQKMIHQ

SEQ ID NO: 394 - protein, 17 aa, synthetic construct
  REGION 1..17: note = Synthetic
KEFLERLKSLIQKMIHQ

SEQ ID NO: 395 - protein, 17 aa, synthetic construct
  REGION 1..17: note = Synthetic
KEFLERLKSLIQKMIHQ

SEQ ID NO: 396 - protein, 17 aa, synthetic construct
  REGION 1..17: note = Synthetic
HMLRDLRDAFSRVKTFF

SEQ ID NO: 397 - protein, 17 aa, synthetic construct
  REGION 1..17: note = Synthetic
HMLRDLRDAFSRVKTFF

SEQ ID NO: 398 - protein, 17 aa, synthetic construct
  REGION 1..17: note = Synthetic
HMLRDLRDAFSRVKTFF

SEQ ID NO: 399 - protein, 17 aa, synthetic construct
  REGION 1..17: note = Synthetic
KEFLERLKSLLQKMIHQ

SEQ ID NO: 400 - protein, 16 aa, synthetic construct
  REGION 1..16: note = Synthetic
KKAASVIQKILKDFGL

SEQ ID NO: 401 - protein, 16 aa, synthetic construct
  REGION 1..16: note = Synthetic
KKAASVIQKILKDFGL

SEQ ID NO: 402 - protein, 15 aa, synthetic construct
  REGION 1..15: note = Synthetic
CMKKGGGHCQAYIGR

SEQ ID NO: 403 - protein, 14 aa, synthetic construct
  REGION 1..14: note = Synthetic
GALKCCKAMCGKVC

SEQ ID NO: 404 - protein, 15 aa, synthetic construct
  REGION 1..15: note = Synthetic
KTLARWAQNAFSKLL

SEQ ID NO: 405 - protein, 15 aa, synthetic construct
  REGION 1..15: note = Synthetic
KTLARWAQNAFSKLL

SEQ ID NO: 406 - protein, 17 aa, synthetic construct
  REGION 1..17: note = Synthetic
KEFLERLKSLLQKMVHQ

SEQ ID NO: 407 - protein, 12 aa, synthetic construct
  REGION 1..12: note = Synthetic
DKVREFFKRIKE

SEQ ID NO: 408 - protein, 15 aa, synthetic construct
  REGION 1..15: note = Synthetic
GKWVDEVCRSLKKYI

SEQ ID NO: 409 - protein, 15 aa, synthetic construct
  REGION 1..15: note = Synthetic
SAMERLNNWLKTFKH

SEQ ID NO: 410 - protein, 32 aa, synthetic construct
  REGION 1..32: note = Synthetic
VVSHIVSQIGDGQLQITTAKKCCHKVHNCCSK

SEQ ID NO: 411 - protein, 18 aa, synthetic construct
  REGION 1..18: note = Synthetic
RRCVNNFDDVFNSVFRKL

SEQ ID NO: 412 - protein, 16 aa, synthetic construct
  REGION 1..16: note = Synthetic
STLRDFLERLKKIMKE

SEQ ID NO: 413 - protein, 16 aa, synthetic construct
  REGION 1..16: note = Synthetic
STLRDFLERLKKIMKE

SEQ ID NO: 414 - protein, 14 aa, synthetic construct
  REGION 1..14: note = Synthetic
LKNLLERLKTIMKE

SEQ ID NO: 415 - protein, 23 aa, synthetic construct
  REGION 1..23: note = Synthetic
SKILRSLQAFLAIAARVFAHGAA

SEQ ID NO: 416 - protein, 23 aa, synthetic construct
  REGION 1..23: note = Synthetic
SKILRSLQAFLAIAARVFAHGAA

SEQ ID NO: 417 - protein, 17 aa, synthetic construct
  REGION 1..17: note = Synthetic
AHLGALLARYIQQARKA

SEQ ID NO: 418 - protein, 13 aa, synthetic construct
  REGION 1..13: note = Synthetic
MKYMGSFLRKAAT

SEQ ID NO: 419 - protein, 13 aa, synthetic construct
  REGION 1..13: note = Synthetic
AVKKYLNSILNGK

SEQ ID NO: 420 - protein, 13 aa, synthetic construct
  REGION 1..13: note = Synthetic
AVKKYLNSILNGK

SEQ ID NO: 421 - protein, 13 aa, synthetic construct
  REGION 1..13: note = Synthetic
AVKKYLNSILNGK

SEQ ID NO: 422 - protein, 13 aa, synthetic construct
  REGION 1..13: note = Synthetic
AVKKYLNSILNGK

SEQ ID NO: 423 - protein, 17 aa, synthetic construct
  REGION 1..17: note = Synthetic
KEYLERLKSLIQKMIHQ

SEQ ID NO: 424 - protein, 15 aa, synthetic construct
  REGION 1..15: note = Synthetic
KNVVEDIKKILQKMW

SEQ ID NO: 425 - protein, 27 aa, synthetic construct
  REGION 1..27: note = Synthetic
QRCNRWCHNGCGNGKGGYYKSMSHGGQ

SEQ ID NO: 426 - protein, 17 aa, synthetic construct
  REGION 1..17: note = Synthetic
REFLERMKSLLQKMIHQ

SEQ ID NO: 427 - protein, 14 aa, synthetic construct
  REGION 1..14: note = Synthetic
KEFLERLKSLIQRV

SEQ ID NO: 428 - protein, 14 aa, synthetic construct
  REGION 1..14: note = Synthetic
EDLYKRYGGFLRRI

SEQ ID NO: 429 - protein, 13 aa, synthetic construct
  REGION 1..13: note = Synthetic
SSVAGVAKKGYRK

SEQ ID NO: 430 - protein, 16 aa, synthetic construct
  REGION 1..16: note = Synthetic
RRLLEAAKEIVSLMHK

SEQ ID NO: 431 - protein, 20 aa, synthetic construct
  REGION 1..20: note = Synthetic
KTLGTAFKTLLHNLWDLLKQ

SEQ ID NO: 432 - protein, 19 aa, synthetic construct
  REGION 1..19: note = Synthetic
LIKRFSTLWRDIWQVASNF

SEQ ID NO: 433 - protein, 14 aa, synthetic construct
  REGION 1..14: note = Synthetic
LKDFLERLKAIMQK

SEQ ID NO: 434 - protein, 15 aa, synthetic construct
  REGION 1..15: note = Synthetic
ANPYQRGCEKINRCR

SEQ ID NO: 435 - protein, 17 aa, synthetic construct
  REGION 1..17: note = Synthetic
CRVARDFLRECMQHLKY

SEQ ID NO: 436 - protein, 12 aa, synthetic construct
  REGION 1..12: note = Synthetic
KTLGKIAEKCDR

SEQ ID NO: 437 - protein, 16 aa, synthetic construct
  REGION 1..16: note = Synthetic
QRCNRWCHNGCGNGKG

SEQ ID NO: 438 - protein, 22 aa, synthetic construct
  REGION 1..22: note = Synthetic
SKAKDAIAGLFTKAKSALKDVL

SEQ ID NO: 439 - protein, 15 aa, synthetic construct
  REGION 1..15: note = Synthetic
KEFLERLKSLIQRMI

SEQ ID NO: 440 - protein, 14 aa, synthetic construct
  REGION 1..14: note = Synthetic
RKAISELIRVMKDL

SEQ ID NO: 441 - protein, 16 aa, synthetic construct
  REGION 1..16: note = Synthetic
KTIQSWLNKFLSCLHI

SEQ ID NO: 442 - protein, 15 aa, synthetic construct
  REGION 1..15: note = Synthetic
MSAIVKVVSNIIRPL

SEQ ID NO: 443 - protein, 17 aa, synthetic construct
  REGION 1..17: note = Synthetic
QEFLNSFSKLMQKLFKN

SEQ ID NO: 444 - protein, 17 aa, synthetic construct
  REGION 1..17: note = Synthetic
QEFLNSFSKLMQKLFKN

SEQ ID NO: 445 - protein, 12 aa, synthetic construct
  REGION 1..12: note = Synthetic
ADKCLRYLLKNI

SEQ ID NO: 446 - protein, 14 aa, synthetic construct
  REGION 1..14: note = Synthetic
FKNCVKNILKDCQT

SEQ ID NO: 447 - protein, 15 aa, synthetic construct
  REGION 1..15: note = Synthetic
LARRMNEVFKEMLRP

SEQ ID NO: 448 - protein, 12 aa, synthetic construct
  REGION 1..12: note = Synthetic
CKWVEKAWKGLL

SEQ ID NO: 449 - protein, 13 aa, synthetic construct
  REGION 1..13: note = Synthetic
ISVAATCAKKIYK

SEQ ID NO: 450 - protein, 16 aa, synthetic construct
  REGION 1..16: note = Synthetic
NELKELVKKASDIIKK

SEQ ID NO: 451 - protein, 15 aa, synthetic construct
  REGION 1..15: note = Synthetic
NIQKCCSNGCGHVCK

SEQ ID NO: 452 - protein, 20 aa, synthetic construct
  REGION 1..20: note = Synthetic
NGLLQRIQSWWKNLFQHGAS

SEQ ID NO: 453 - protein, 16 aa, synthetic construct
  REGION 1..16: note = Synthetic
TTLKDFLENLKRIMQK

SEQ ID NO: 454 - protein, 17 aa, synthetic construct
  REGION 1..17: note = Synthetic
FREIPQCINSICKCMKG

SEQ ID NO: 455 - protein, 16 aa, synthetic construct
  REGION 1..16: note = Synthetic
DALSKLFRIYSNFLRG

SEQ ID NO: 456 - protein, 16 aa, synthetic construct
  REGION 1..16: note = Synthetic
DALSKLFRIYSNFLRG

SEQ ID NO: 457 - protein, 12 aa, synthetic construct
  REGION 1..12: note = Synthetic
GYNAAYNRYFRK

SEQ ID NO: 458 - protein, 12 aa, synthetic construct
  REGION 1..12: note = Synthetic
GYNAAYNRYFRK

SEQ ID NO: 459 - protein, 15 aa, synthetic construct
  REGION 1..15: note = Synthetic
DSIFSKMYNCWRKCA

SEQ ID NO: 460 - protein, 13 aa, synthetic construct
  REGION 1..13: note = Synthetic
FRFLKGYWSKFTD

SEQ ID NO: 461 - protein, 15 aa, synthetic construct
  REGION 1..15: note = Synthetic
QELFSLLKRLINKVN

SEQ ID NO: 462 - protein, 15 aa, synthetic construct
  REGION 1..15: note = Synthetic
QELFSLLKRLINKVN

SEQ ID NO: 463 - protein, 16 aa, synthetic construct
  REGION 1..16: note = Synthetic
KLIDTVIKQLRNLIAT

SEQ ID NO: 464 - protein, 16 aa, synthetic construct
  REGION 1..16: note = Synthetic
LLEKIKTCWNKILSGT

SEQ ID NO: 465 - protein, 21 aa, synthetic construct
  REGION 1..21: note = Synthetic
GGGGGGGGGARRMKGLAKKAM

SEQ ID NO: 466 - protein, 17 aa, synthetic construct
  REGION 1..17: note = Synthetic
AAWFQFFNRFLKYITSL

SEQ ID NO: 467 - protein, 16 aa, synthetic construct
  REGION 1..16: note = Synthetic
TTLKDFLENLKTILKK

SEQ ID NO: 468 - protein, 15 aa, synthetic construct
  REGION 1..15: note = Synthetic
VHPYSRGCSSITRCR

SEQ ID NO: 469 - protein, 17 aa, synthetic construct
  REGION 1..17: note = Synthetic
LQSILELVHRVLRHLAQ

SEQ ID NO: 470 - protein, 17 aa, synthetic construct
  REGION 1..17: note = Synthetic
LQSFLELVHRVLRHLAQ

SEQ ID NO: 471 - protein, 12 aa, synthetic construct
  REGION 1..12: note = Synthetic
CLKSAANAIKGI

SEQ ID NO: 472 - protein, 21 aa, synthetic construct
  REGION 1..21: note = Synthetic
SVYAQLSSVARTMIKRLEHFI

SEQ ID NO: 473 - protein, 11 aa, synthetic construct
  REGION 1..11: note = Synthetic
AVKKYLNSILN

SEQ ID NO: 474 - protein, 11 aa, synthetic construct
  REGION 1..11: note = Synthetic
AVKKYLNSILN

SEQ ID NO: 475 - protein, 11 aa, synthetic construct
  REGION 1..11: note = Synthetic
AVKKYLNSILN

SEQ ID NO: 476 - protein, 11 aa, synthetic construct
  REGION 1..11: note = Synthetic
AVKKYLNSILN

SEQ ID NO: 477 - protein, 15 aa, synthetic construct
  REGION 1..15: note = Synthetic
QVGQILRECAKNLKN

SEQ ID NO: 478 - protein, 14 aa, synthetic construct
  REGION 1..14: note = Synthetic
HKAVNELIRVIHQL

SEQ ID NO: 479 - protein, 33 aa, synthetic construct
  REGION 1..33: note = Synthetic
RLLHGLLHSLLHSFSHKFLDSFMRHMCTVCRNM

SEQ ID NO: 480 - protein, 12 aa, synthetic construct
  REGION 1..12: note = Synthetic
YWIHMLRYVAKT

SEQ ID NO: 481 - protein, 12 aa, synthetic construct
  REGION 1..12: note = Synthetic
AVKKYLAAVLGK

SEQ ID NO: 482 - protein, 12 aa, synthetic construct
  REGION 1..12: note = Synthetic
AVKKYLAAVLGK

SEQ ID NO: 483 - protein, 12 aa, synthetic construct
  REGION 1..12: note = Synthetic
AVKKYLAAVLGK

SEQ ID NO: 484 - protein, 12 aa, synthetic construct
  REGION 1..12: note = Synthetic
AVKKYLAAVLGK

SEQ ID NO: 485 - protein, 12 aa, synthetic construct
  REGION 1..12: note = Synthetic
AVKKYLAAVLGK

SEQ ID NO: 486 - protein, 12 aa, synthetic construct
  REGION 1..12: note = Synthetic
AVKKYLAAVLGK

SEQ ID NO: 487 - protein, 12 aa, synthetic construct
  REGION 1..12: note = Synthetic
AVKKYLAAVLGK

SEQ ID NO: 488 - protein, 12 aa, synthetic construct
  REGION 1..12: note = Synthetic
AVKKYLAAVLGK

SEQ ID NO: 489 - protein, 12 aa, synthetic construct
  REGION 1..12: note = Synthetic
AVKKYLAAVLGK

SEQ ID NO: 490 - protein, 12 aa, synthetic construct
  REGION 1..12: note = Synthetic
LKKFLQFIYYCC

SEQ ID NO: 491 - protein, 15 aa, synthetic construct
  REGION 1..15: note = Synthetic
LSDAKQWIKTMFKNW

SEQ ID NO: 492 - protein, 14 aa, synthetic construct
  REGION 1..14: note = Synthetic
AKGKQMLKEYANKV

SEQ ID NO: 493 - protein, 16 aa, synthetic construct
  REGION 1..16: note = Synthetic
GMFNKAYRKALGQLSA

SEQ ID NO: 494 - protein, 17 aa, synthetic construct
  REGION 1..17: note = Synthetic
GGLSTWKKLLDTILKIP

SEQ ID NO: 495 - protein, 13 aa, synthetic construct
  REGION 1..13: note = Synthetic
CLKNMASSFRNLN

SEQ ID NO: 496 - protein, 13 aa, synthetic construct
  REGION 1..13: note = Synthetic
CLKNMASSFRNLN

SEQ ID NO: 497 - protein, 15 aa, synthetic construct
  REGION 1..15: note = Synthetic
VTCASQALKRGCKSV

SEQ ID NO: 498 - protein, 17 aa, synthetic construct
  REGION 1..17: note = Synthetic
CSSWPHLLREILRAARL

SEQ ID NO: 499 - protein, 15 aa, synthetic construct
  REGION 1..15: note = Synthetic
RKAVSELKKVMNDLL

SEQ ID NO: 500 - protein, 20 aa, synthetic construct
  REGION 1..20: note = Synthetic
GQVRNFGNACEKIVHSCKTG

SEQ ID NO: 501 - protein, 14 aa, synthetic construct
  REGION 1..14: note = Synthetic
AFKSFWQKLFAIFG

SEQ ID NO: 502 - protein, 18 aa, synthetic construct
  REGION 1..18: note = Synthetic
ARLTKLAEQLMEKIKNLC

SEQ ID NO: 503 - protein, 12 aa, synthetic construct
  REGION 1..12: note = Synthetic
GKRYIRGCADTC

SEQ ID NO: 504 - protein, 16 aa, synthetic construct
  REGION 1..16: note = Synthetic
NKYRRGCSAATGCYRF

SEQ ID NO: 505 - protein, 15 aa, synthetic construct
  REGION 1..15: note = Synthetic
NKGMEEFKKIVRTLT

SEQ ID NO: 506 - protein, 14 aa, synthetic construct
  REGION 1..14: note = Synthetic
VATVKNCGKKLLAT

SEQ ID NO: 507 - protein, 17 aa, synthetic construct
  REGION 1..17: note = Synthetic
NMLRDLRDAFSRVKTFF

SEQ ID NO: 508 - protein, 17 aa, synthetic construct
  REGION 1..17: note = Synthetic
NMLRDLRDAFSRVKTFF

SEQ ID NO: 509 - protein, 16 aa, synthetic construct
  REGION 1..16: note = Synthetic
RKLKKYLEALDNFLNF

SEQ ID NO: 510 - protein, 27 aa, synthetic construct
  REGION 1..27: note = Synthetic
KHAHSMITSMLTFVSSVMNFGRSFVKD

SEQ ID NO: 511 - protein, 27 aa, synthetic construct
  REGION 1..27: note = Synthetic
KHAHSMITSMLTFVSSVMNFGRSFVKD

SEQ ID NO: 512 - protein, 12 aa, synthetic construct
  REGION 1..12: note = Synthetic
RAHQVLANLLKM

SEQ ID NO: 513 - protein, 15 aa, synthetic construct
  REGION 1..15: note = Synthetic
QKFLNKIYQYYQTFL

SEQ ID NO: 514 - protein, 12 aa, synthetic construct
  REGION 1..12: note = Synthetic
EKFKRIANSFLQ

SEQ ID NO: 515 - protein, 12 aa, synthetic construct
  REGION 1..12: note = Synthetic
EKFKRIANSFLQ

SEQ ID NO: 516 - protein, 13 aa, synthetic construct
  REGION 1..13: note = Synthetic
RHLARTLLTAARE

SEQ ID NO: 517 - protein, 21 aa, synthetic construct
  REGION 1..21: note = Synthetic
CARLRHVARGIADAQAVLSGL

SEQ ID NO: 518 - protein, 12 aa, synthetic construct
  REGION 1..12: note = Synthetic
RALKKIIKRLCR

SEQ ID NO: 519 - protein, 12 aa, synthetic construct
  REGION 1..12: note = Synthetic
CSRFVQCCRRVW

SEQ ID NO: 520 - protein, 12 aa, synthetic construct
  REGION 1..12: note = Synthetic
CSRFVQCCRRVW

SEQ ID NO: 521 - protein, 27 aa, synthetic construct
  REGION 1..27: note = Synthetic
KKIGRGLKKIGQKIKDFLGNLVPRTES

SEQ ID NO: 522 - protein, 27 aa, synthetic construct
  REGION 1..27: note = Synthetic
EKIGRGLKKIGQKIKDFWGNLVPRTES

SEQ ID NO: 523 - protein, 27 aa, synthetic construct
  REGION 1..27: note = Synthetic
EKIGKEFKRIVQRIKDFLQHLVPRTEA

SEQ ID NO: 524 - protein, 27 aa, synthetic construct
  REGION 1..27: note = Synthetic
EKIGKEFKRIVQRIKDFLQHLVPRTEA

SEQ ID NO: 525 - protein, 27 aa, synthetic construct
  REGION 1..27: note = Synthetic
EKIGKEFKRIVQRIKDFLQHLVPRTEA

SEQ ID NO: 526 - protein, 27 aa, synthetic construct
  REGION 1..27: note = Synthetic
KKIGEEFKRIVQRIKDFLQHLIPRTEA

SEQ ID NO: 527 - protein, 19 aa, synthetic construct
  REGION 1..19: note = Synthetic
RRWAQVVEQILRNLIDLIH

SEQ ID NO: 528 - protein, 14 aa, synthetic construct
  REGION 1..14: note = Synthetic
ARRIGERIKDIFRG

SEQ ID NO: 529 - protein, 13 aa, synthetic construct
  REGION 1..13: note = Synthetic
FIGGIISFFKRLF

SEQ ID NO: 530 - protein, 13 aa, synthetic construct
  REGION 1..13: note = Synthetic
FIGGIISFFKRLF

SEQ ID NO: 531 - protein, 12 aa, synthetic construct
  REGION 1..12: note = Synthetic
IGGIISFFKRLF

SEQ ID NO: 532 - protein, 34 aa, synthetic construct
  REGION 1..34: note = Synthetic
KRFKKFFKKVKKSVKKRLKKIFKKPMVIGVTIPF

SEQ ID NO: 533 - protein, 27 aa, synthetic construct
  REGION 1..27: note = Synthetic
KKIGGGLKKIGQKIKDFLGNLVPRTAS

SEQ ID NO: 534 - protein, 27 aa, synthetic construct
  REGION 1..27: note = Synthetic
EKIARGFKKIGQKINDFLGKLAPRTEA

SEQ ID NO: 535 - protein, 35 aa, synthetic construct
  REGION 1..35: note = Synthetic
VKRFKKFFKKLKNSVKKRVKKFFRKPRVIGVTFPF

SEQ ID NO: 536 - protein, 14 aa, synthetic construct
  REGION 1..14: note = Synthetic
FLKSFAKLIKKVIR

SEQ ID NO: 537 - protein, 14 aa, synthetic construct
  REGION 1..14: note = Synthetic
FLKSFAKLIRKVIR

SEQ ID NO: 538 - protein, 14 aa, synthetic construct
  REGION 1..14: note = Synthetic
FLKSLAKLIKKVIR

SEQ ID NO: 539 - protein, 11 aa, synthetic construct
  REGION 1..11: note = Synthetic
MKNLLDDLFGL

SEQ ID NO: 540 - protein, 14 aa, synthetic construct
  REGION 1..14: note = Synthetic
FLKSFAKLIKKVIR

SEQ ID NO: 541 - protein, 14 aa, synthetic construct
  REGION 1..14: note = Synthetic
FLKSFAKLIKKVIR

SEQ ID NO: 542 - protein, 16 aa, synthetic construct
  REGION 1..16: note = Synthetic
VQQIFQRIIRVLRSTL

SEQ ID NO: 543 - protein, 34 aa, synthetic construct; identical to SEQ ID NO: 532
  REGION 1..34: note = Synthetic

SEQ ID NO: 544 - protein, 34 aa, synthetic construct
  REGION 1..34: note = Synthetic
KRFKKFFKKVKKSVKKRLKKIFKKPMVIGVTFPF

SEQ ID NO: 545 - protein, 32 aa, synthetic construct
  REGION 1..32: note = Synthetic
FSKILRSIAKVFKGVGKVRKQFKTASDLDKNQ

SEQ ID NO: 546 - protein, 33 aa, synthetic construct
  REGION 1..33: note = Synthetic
VFGKILRSIAKVFKGVGKVRKQFKTASDLDKNQ

SEQ ID NO: 547 - protein, 15 aa, synthetic construct
  REGION 1..15: note = Synthetic
MRRCLQLIEKVIRKL

SEQ ID NO: 548 - protein, 11 aa, synthetic construct
  REGION 1..11: note = Synthetic
LAKLVKHIHEY

SEQ ID NO: 549 - protein, 11 aa, synthetic construct
  REGION 1..11: note = Synthetic
LAKLVKHIHEY

SEQ ID NO: 550 - protein, 12 aa, synthetic construct
  REGION 1..12: note = Synthetic
WKAILDAVKKVL

SEQ ID NO: 551 - protein, 35 aa, synthetic construct
  REGION 1..35: note = Synthetic
VKRFKKFFRKLKKSVKKRAKEFFKKPRVIGVSIPF

SEQ ID NO: 552 - protein, 14 aa, synthetic construct
  REGION 1..14: note = Synthetic
FLKSFEKLIKKVIR

SEQ ID NO: 553 - protein, 23 aa, synthetic construct
  REGION 1..23: note = Synthetic
KEFKRIVQRIKDFLQHLVPRTEA

SEQ ID NO: 554 - protein, 23 aa, synthetic construct
  REGION 1..23: note = Synthetic
KEFKRIVQRIKDFLQHLVPRTEA

SEQ ID NO: 555 - protein, 23 aa, synthetic construct
  REGION 1..23: note = Synthetic
KEFKRIVQRIKDFLQHLVPRTEA

SEQ ID NO: 556 - protein, 15 aa, synthetic construct
  REGION 1..15: note = Synthetic
MRRCLQLIDKVIRKL

SEQ ID NO: 557 - protein, 15 aa, synthetic construct
  REGION 1..15: note = Synthetic
MRRCLQLIDKVIRKL

SEQ ID NO: 558 - protein, 34 aa, synthetic construct
  REGION 1..34: note = Synthetic
WFQFFNRFLKYITSLTNTTILGPANFTLPFYSSI

SEQ ID NO: 559 - protein, 15 aa, synthetic construct
  REGION 1..15: note = Synthetic
MRRCLQLIDKVIRKL

SEQ ID NO: 560 - protein, 15 aa, synthetic construct
  REGION 1..15: note = Synthetic
DVFSSIFRNIFNLFR

SEQ ID NO: 561 - protein, 15 aa, synthetic construct
  REGION 1..15: note = Synthetic
MRRCLQLIDKVIRKL

SEQ ID NO: 562 - protein, 26 aa, synthetic construct
  REGION 1..26: note = Synthetic
KIGEEFKRIVQRIKDFLRNLVPRTES

SEQ ID NO: 563 - protein, 23 aa, synthetic construct
  REGION 1..23: note = Synthetic
EEFKRIVQRIKDFLRNLVPRTES

SEQ ID NO: 564 - protein, 35 aa, synthetic construct
  REGION 1..35: note = Synthetic
VKRFKKFFKKLKNSVKKRAKKFFKKPRVIGVSIPF

SEQ ID NO: 565 - protein, 29 aa, synthetic construct
  REGION 1..29: note = Synthetic
VGGLRSLGRKILRAWKKYGPIIVPIIRIG

SEQ ID NO: 566 - protein, 23 aa, synthetic construct
  REGION 1..23: note = Synthetic
EEFKRIVQRIKDFLQHLIPRTEA

SEQ ID NO: 567 - protein, 15 aa, synthetic construct
  REGION 1..15: note = Synthetic
MRKCLQLIDKVIRKL

SEQ ID NO: 568 - protein, 15 aa, synthetic construct
  REGION 1..15: note = Synthetic
MRRCLQLIDKVIRKL

SEQ ID NO: 569 - protein, 15 aa, synthetic construct
  REGION 1..15: note = Synthetic
MRRCLQLIDKVIRKL

SEQ ID NO: 570 - protein, 15 aa, synthetic construct
  REGION 1..15: note = Synthetic
MRRCLQLIDKVIRKL

SEQ ID NO: 571 - protein, 15 aa, synthetic construct
  REGION 1..15: note = Synthetic
MRRCLQLIDKVIRKL

SEQ ID NO: 572 - protein, 13 aa, synthetic construct
  REGION 1..13: note = Synthetic
FVQWFSKFLGRIL

SEQ ID NO: 573 - protein, 30 aa, synthetic construct
  REGION 1..30: note = Synthetic
VRGLRRLGRKIAHGVKKYGPTVLRIIRIAG

SEQ ID NO: 574 - protein, 30 aa, synthetic construct; identical to SEQ ID NO: 573
  REGION 1..30: note = Synthetic

SEQ ID NO: 575 - protein, 15 aa, synthetic construct
  REGION 1..15: note = Synthetic
EFLKSFAKLIKKVIR

SEQ ID NO: 576 - protein, 15 aa, synthetic construct
  REGION 1..15: note = Synthetic
MRRCLQFIDKVIRKL

SEQ ID NO: 577 - protein, 14 aa, synthetic construct
  REGION 1..14: note = Synthetic
FLKSFAKLIKQVIR

SEQ ID NO: 578 - protein, 15 aa, synthetic construct
  REGION 1..15: note = Synthetic
MRRCLQLIDKVIRKL

SEQ ID NO: 579 - protein, 14 aa, synthetic construct
  REGION 1..14: note = Synthetic
FLKSFAKLIKQVIR

SEQ ID NO: 580 - protein, 32 aa, synthetic construct
  REGION 1..32: note = Synthetic
FAKILKSIAKFFKGVGKVRKQFKEASDLDKNQ

SEQ ID NO: 581 - protein, 14 aa, synthetic construct
  REGION 1..14: note = Synthetic
RRCLQLIDKVIRKL

SEQ ID NO: 582 - protein, 14 aa, synthetic construct
  REGION 1..14: note = Synthetic
EFLKSFAKLIKKVI

SEQ ID NO: 583 - protein, 12 aa, synthetic construct
  REGION 1..12: note = Synthetic
LLKIAKGIIKSL

SEQ ID NO: 584 - protein, 15 aa, synthetic construct
  REGION 1..15: note = Synthetic
MRRCLQLIDKVIRKL

SEQ ID NO: 585 - protein, 15 aa, synthetic construct
  REGION 1..15: note = Synthetic
MRRCLQLIDKVVRKL

SEQ ID NO: 586 - protein, 15 aa, synthetic construct
  REGION 1..15: note = Synthetic
EFLKSFAKLIKQVIR

SEQ ID NO: 587 - protein, 15 aa, synthetic construct
  REGION 1..15: note = Synthetic
EFLKSFAKLIKQVIR

SEQ ID NO: 588 - protein, 15 aa, synthetic construct
  REGION 1..15: note = Synthetic
MRRCLQLIDKVMRKL

SEQ ID NO: 589 - protein, 35 aa, synthetic construct
  REGION 1..35: note = Synthetic
VKRFKKFFKKLKNSVKKRAKKFFKKPKVIGVTFPF

SEQ ID NO: 590 - protein, 17 aa, synthetic construct
  REGION 1..17: note = Synthetic
TIIERLYKLWRDWKRKV

SEQ ID NO: 591 - protein, 32 aa, synthetic construct
  REGION 1..32: note = Synthetic
ISKVLRAIAKFFKGVGKARKQFKEASDLDKNQ

SEQ ID NO: 592 - protein, 15 aa, synthetic construct
  REGION 1..15: note = Synthetic
MRRCLQLIDKAIRKI

SEQ ID NO: 593 - protein, 12 aa, synthetic construct
  REGION 1..12: note = Synthetic
FRKIVSTIKNVV

SEQ ID NO: 594 - protein, 39 aa, synthetic construct
  REGION 1..39: note = Synthetic
WLRKLGKKIERIGQHTRDASIQVLGIAQQAANVAATARG

SEQ ID NO: 595 - protein, 39 aa, synthetic construct; identical to SEQ ID NO: 594
  REGION 1..39: note = Synthetic

SEQ ID NO: 596 - protein, 39 aa, synthetic construct; identical to SEQ ID NO: 594
  REGION 1..39: note = Synthetic

SEQ ID NO: 597 - protein, 39 aa, synthetic construct; identical to SEQ ID NO: 594
  REGION 1..39: note = Synthetic

SEQ ID NO: 598 - protein, 15 aa, synthetic construct
  REGION 1..15: note = Synthetic
MRKCLQLVDKVIRKL

SEQ ID NO: 599 - protein, 39 aa, synthetic construct
  REGION 1..39: note = Synthetic
WLKKLGKRIERIGQHTRDATIQGLGIAQQAANVAATARG

SEQ ID NO: 600 - protein, 39 aa, synthetic construct; identical to SEQ ID NO: 599
  REGION 1..39: note = Synthetic

SEQ ID NO: 601 - protein, 39 aa, synthetic construct; identical to SEQ ID NO: 599
  REGION 1..39: note = Synthetic

SEQ ID NO: 602 - protein, 39 aa, synthetic construct; identical to SEQ ID NO: 599
  REGION 1..39: note = Synthetic

SEQ ID NO: 603 - protein, 39 aa, synthetic construct; identical to SEQ ID NO: 599
  REGION 1..39: note = Synthetic

SEQ ID NO: 604 - protein, 39 aa, synthetic construct; identical to SEQ ID NO: 599
  REGION 1..39: note = Synthetic

SEQ ID NO: 605 - protein, 39 aa, synthetic construct; identical to SEQ ID NO: 599
  REGION 1..39: note = Synthetic

SEQ ID NO: 606 - protein, 39 aa, synthetic construct; identical to SEQ ID NO: 599
  REGION 1..39: note = Synthetic

SEQ ID NO: 607 - protein, 39 aa, synthetic construct; identical to SEQ ID NO: 599
  REGION 1..39: note = Synthetic

SEQ ID NO: 608 - protein, 13 aa, synthetic construct
  REGION 1..13: note = Synthetic
FIGGIISFIKKLF

SEQ ID NO: 609 - protein, 13 aa, synthetic construct
  REGION 1..13: note = Synthetic
FIGGIISFIKKLF

SEQ ID NO: 610 - protein, 13 aa, synthetic construct
  REGION 1..13: note = Synthetic
FIGGIISLIKKLF

SEQ ID NO: 611 - protein, 14 aa, synthetic construct
  REGION 1..14: note = Synthetic
EFLKSFAKLIQKVI

SEQ ID NO: 612 - protein, 15 aa, synthetic construct
  REGION 1..15: note = Synthetic
MRRCLQLVDKVIRKL

SEQ ID NO: 613 - protein, 36 aa, synthetic construct
  REGION 1..36: note = Synthetic
RRFKKFLKKVEGAGRRVANAAQKGLPLAAGVKGLVG

SEQ ID NO: 614 - protein, 14 aa, synthetic construct
  REGION 1..14: note = Synthetic
FLKSFAKLIQQVIR

SEQ ID NO: 615 - protein, 28 aa, synthetic construct
  REGION 1..28: note = Synthetic
FFGKMKEYFKKFGASFKRRFANLKKRLG

SEQ ID NO: 616 - protein, 15 aa, synthetic construct
  REGION 1..15: note = Synthetic
MRRCLQLIDKAIKKL

SEQ ID NO: 617 - protein, 11 aa, synthetic construct
  REGION 1..11: note = Synthetic
LKKWFKRCPKY

SEQ ID NO: 618 - protein, 23 aa, synthetic construct
  REGION 1..23: note = Synthetic
FVKRLLDEIKTCWNKILRGAKKH

SEQ ID NO: 619 - protein, 15 aa, synthetic construct
  REGION 1..15: note = Synthetic
EFLKSFEKLIQKVIR

SEQ ID NO: 620 - protein, 15 aa, synthetic construct
  REGION 1..15: note = Synthetic
MRRCLQFVDKVIKRL

SEQ ID NO: 621 - protein, 15 aa, synthetic construct
  REGION 1..15: note = Synthetic
EFLQSFGKLINKVIR

SEQ ID NO: 622 - protein, 27 aa, synthetic construct
  REGION 1..27: note = Synthetic
EKIGGGLKKVGQKIKDFLGNLVPRTAS

SEQ ID NO: 623 - protein, 27 aa, synthetic construct
  REGION 1..27: note = Synthetic
EKIGGGLKKVGQKIKDFLGNLVPRTAS

SEQ ID NO: 624 - protein, 27 aa, synthetic construct
  REGION 1..27: note = Synthetic
EKIGGGLKKVGQKIKDFLGNLVPRTAS

SEQ ID NO: 625 - protein, 27 aa, synthetic construct
  REGION 1..27: note = Synthetic
EKIGGGLKKVGQKIKDFLGNLVPRTAS

SEQ ID NO: 626 - protein, 23 aa, synthetic construct
  REGION 1..23: note = Synthetic
FVKRLLDEIKTCWNKILRGAKKH

SEQ ID NO: 627 - protein, 34 aa, synthetic construct
  REGION 1..34: note = Synthetic
LKKLGKKIEKAGKRVFNAVQKGLPVAAGVQALGR

SEQ ID NO: 628 - protein, 13 aa, synthetic construct
  REGION 1..13: note = Synthetic
LKGLIKKVASLLN

SEQ ID NO: 629 - protein, 14 aa, synthetic construct
  REGION 1..14: note = Synthetic
FLKSFAKLIQQVIR

SEQ ID NO: 630 - protein, 11 aa, synthetic construct
  REGION 1..11: note = Synthetic
LDDLLSKFPDY

SEQ ID NO: 631 - protein, 27 aa, synthetic construct
  REGION 1..27: note = Synthetic
EKIGEKLKKIGQKIKNFFQKLVPQPEQ

SEQ ID NO: 632 - protein, 38 aa, synthetic construct
  REGION 1..38: note = Synthetic
WLRKIGKKIERVGQHTRDATIQVLGIAQQAANVAATAR

SEQ ID NO: 633 - protein, 31 aa, synthetic construct
  REGION 1..31: note = Synthetic
KFGKRLEKLGRNVFRAAKKALPVIAGYKALG

SEQ ID NO: 634 - protein, 14 aa, synthetic construct
  REGION 1..14: note = Synthetic
FLKSFAKLIQQVIR

SEQ ID NO: 635 - protein, 14 aa, synthetic construct
  REGION 1..14: note = Synthetic
EFLKSFAKLIQKVI

SEQ ID NO: 636 - protein, 39 aa, synthetic construct
  REGION 1..39: note = Synthetic
WLKKIGKKIERIGQHTRDATIQGLGIAQQAANVAATARG

SEQ ID NO: 637 - protein, 15 aa, synthetic construct
  REGION 1..15: note = Synthetic
MRRCLQLIDKAIRKL

SEQ ID NO: 638 - protein, 15 aa, synthetic construct
  REGION 1..15: note = Synthetic
MRRCLQLIDKVARKL

SEQ ID NO: 639 - protein, 24 aa, synthetic construct
  REGION 1..24: note = Synthetic
CCDLIRKCWHDIKECWKRCHGGKV

SEQ ID NO: 640 - protein, 14 aa, synthetic construct
  REGION 1..14: note = Synthetic
FLKSFANLIKQVIR

SEQ ID NO: 641 - protein, 21 aa, synthetic construct
  REGION 1..21: note = Synthetic
FLKRLLREIKTCWNKILKGSI

SEQ ID NO: 642 - protein, 21 aa, synthetic construct
  REGION 1..21: note = Synthetic
FLKRLLREIKTCWNKILKGSI

SEQ ID NO: 643 - protein, 23 aa, synthetic construct
  REGION 1..23: note = Synthetic
FVKRLLDEIKTCWNKILRGAKKH

SEQ ID NO: 644 - protein, 15 aa, synthetic construct
  REGION 1..15: note = Synthetic
EFLKSFAKLIQQVIR

SEQ ID NO: 645 - protein, 14 aa, synthetic construct
  REGION 1..14: note = Synthetic
FLQSFAKLIKQVIR

SEQ ID NO: 646 - protein, 11 aa, synthetic construct
  REGION 1..11: note = Synthetic
SLLSLIRKLIT

SEQ ID NO: 647 - protein, 26 aa, synthetic construct
  REGION 1..26: note = Synthetic
FFKWISKFIRRLSKCGIKSITSKAYK

SEQ ID NO: 648 - protein, 27 aa, synthetic construct
  REGION 1..27: note = Synthetic
EKIEGGLKKLVQKIKDFFGKFAPRTES

SEQ ID NO: 649 - protein, 23 aa, synthetic construct
  REGION 1..23: note = Synthetic
FVKRLLDEIKTCWNKILRGAKKH

SEQ ID NO: 650 - protein, 35 aa, synthetic construct
  REGION 1..35: note = Synthetic
KIFKKIEKMGRNIRDGIVKAGPAIEVLGSAKAIGK

SEQ ID NO: 651 - protein, 28 aa, synthetic construct
  REGION 1..28: note = Synthetic
GRFGRFLRKIRRFRPKVTITIQGSARFG

SEQ ID NO: 652 - protein, 13 aa, synthetic construct
  REGION 1..13: note = Synthetic
WKKLLDTILKIPV

SEQ ID NO: 653 - protein, 15 aa, synthetic construct
  REGION 1..15: note = Synthetic
FLKSFAKLIQKVIKS

SEQ ID NO: 654 - protein, 16 aa, synthetic construct
  REGION 1..16: note = Synthetic
IRRCLQLIDKAVRKLY

SEQ ID NO: 655 - protein, 26 aa, synthetic construct
  REGION 1..26: note = Synthetic
LDALHDLMSSVIRLLKNINKRFGCAL

SEQ ID NO: 656 - protein, 21 aa, synthetic construct
  REGION 1..21: note = Synthetic
FLKRLLREIKTCWNKILKGSI

SEQ ID NO: 657 - protein, 21 aa, synthetic construct
  REGION 1..21: note = Synthetic
FLKRLLREIKTCWNKILKGSI

SEQ ID NO: 658 - protein, 21 aa, synthetic construct
  REGION 1..21: note = Synthetic
FLKRLLREIKTCWNKILKGSI

SEQ ID NO: 659 - protein, 25 aa, synthetic construct
  REGION 1..25: note = Synthetic
ILANIHKIIKAYQRSIIKLPVTKGL

SEQ ID NO: 660 - protein, 21 aa, synthetic construct
  REGION 1..21: note = Synthetic
IHHIFRGIVHAGRSIGRFLTG

SEQ ID NO: 661 - protein, 28 aa, synthetic construct
  REGION 1..28: note = Synthetic
KPLKEFLERLKSLIQKMIHQHLSRTHGI

SEQ ID NO: 662 - protein, 22 aa, synthetic construct
  REGION 1..22: note = Synthetic
KNLKEFLERLKSLIQKMIHQHL

SEQ ID NO: 663 - protein, 15 aa, synthetic construct
  REGION 1..15: note = Synthetic
WKKIASIGKEVLKAL

SEQ ID NO: 664 - protein, 39 aa, synthetic construct
  REGION 1..39: note = Synthetic
WLKKIGKKIERVGQHTRDATIQTIAVAQQAANVAATARG

SEQ ID NO: 665 - protein, 39 aa, synthetic construct
  REGION 1..39: note = Synthetic
WLKKIGKKIERVGQHTRDATIQGLGIAQQAANVAATARG

SEQ ID NO: 666 - protein, 39 aa, synthetic construct
  REGION 1..39: note = Synthetic
WLKKIGKKIERVGQHTRDATIQGLGVAQQAANVAATARG

SEQ ID NO: 667 - protein, 39 aa, synthetic construct; identical to SEQ ID NO: 666
  REGION 1..39: note = Synthetic

SEQ ID NO: 668 - protein, 39 aa, synthetic construct; identical to SEQ ID NO: 665
  REGION 1..39: note = Synthetic

SEQ ID NO: 669 - protein, 39 aa, synthetic construct; identical to SEQ ID NO: 665
  REGION 1..39: note = Synthetic

SEQ ID NO: 670 - protein, 39 aa, synthetic construct
  REGION 1..39: note = Synthetic
WLKKIGKKIERVGQHTRDATIQVIGVAQQAANVAATARG

SEQ ID NO: 671 - protein, 23 aa, synthetic construct
  REGION 1..23: note = Synthetic
ARSWKSMAKKLKEYMEKLKQRAG

SEQ ID NO: 672 - protein, 14 aa, synthetic construct
  REGION 1..14: note = Synthetic
LRSCWNKFEKIISR

SEQ ID NO: 673 - protein, 26 aa, synthetic construct
  REGION 1..26: note = Synthetic
LFQKIKRWWKRIFDREASRSARALRR

SEQ ID NO: 674 - protein, 12 aa, synthetic construct
  REGION 1..12: note = Synthetic
FRKIATVVKNLV

SEQ ID NO: 675 - protein, 23 aa, synthetic construct
  REGION 1..23: note = Synthetic
FVKRLLDEIKTCWNKILRGAKKH

SEQ ID NO: 676 - protein, 12 aa, synthetic construct
  REGION 1..12: note = Synthetic
WKALLDAAKKVL

SEQ ID NO: 677 - protein, 14 aa, synthetic construct
  REGION 1..14: note = Synthetic
LRSCWNKFEKLISR

SEQ ID NO: 678 - protein, 14 aa, synthetic construct
  REGION 1..14: note = Synthetic
KEFLQSFSKLMKKV

SEQ ID NO: 679 - protein, 11 aa, synthetic construct
  REGION 1..11: note = Synthetic
NALGGLIKKIG

SEQ ID NO: 680 - protein, 11 aa, synthetic construct
  REGION 1..11: note = Synthetic
NALGGLIKKIG

SEQ ID NO: 681 - protein, 33 aa, synthetic construct
  REGION 1..33: note = Synthetic
KIFKKIEKVGRNIRNGIIKAGPAVAVLGEAKAL

SEQ ID NO: 682 - protein, 20 aa, synthetic construct
  REGION 1..20: note = Synthetic
VKRFIEKLRTFLRKLSRGAK

SEQ ID NO: 683 - protein, 35 aa, synthetic construct
  REGION 1..35: note = Synthetic
KVFKKIEKMGRNIRDGIVKAGPAIEVLGSAKALGK

SEQ ID NO: 684 - protein, 12 aa, synthetic construct
  REGION 1..12: note = Synthetic
LGKFCDEIKRIV

SEQ ID NO: 685 - protein, 38 aa, synthetic construct
  REGION 1..38: note = Synthetic
IKAIKTVGKAVGKGLRAINIASTANDVFNFLKPKKRKH

SEQ ID NO: 686 - protein, 38 aa, synthetic construct; identical to SEQ ID NO: 685
  REGION 1..38: note = Synthetic

SEQ ID NO: 687 - protein, 15 aa, synthetic construct
  REGION 1..15: note = Synthetic
IKDILAKLVKVLGHV

SEQ ID NO: 688 - protein, 21 aa, synthetic construct
  REGION 1..21: note = Synthetic
FLKRLLREIKTCWNKILNSSI

SEQ ID NO: 689 - protein, 13 aa, synthetic construct
  REGION 1..13: note = Synthetic
LKGIFKKVASLLT

SEQ ID NO: 690 - protein, 35 aa, synthetic construct
  REGION 1..35: note = Synthetic
KLFKKIEKVGRNVRDGLIKAGPAIAVIGQAKSLGK

SEQ ID NO: 691 - protein, 14 aa, synthetic construct
  REGION 1..14: note = Synthetic
KEFLERLKSLIQRV

SEQ ID NO: 692 - protein, 14 aa, synthetic construct
  REGION 1..14: note = Synthetic
DLIRKAVSVIKNIV

SEQ ID NO: 693 - protein, 17 aa, synthetic construct
  REGION 1..17: note = Synthetic
WNQILSNLHSIMQQMIN

SEQ ID NO: 694 - protein, 23 aa, synthetic construct
  REGION 1..23: note = Synthetic
KPIKEFLERLKSLIQKMIHQRLS

SEQ ID NO: 695 - protein, 23 aa, synthetic construct
  REGION 1..23: note = Synthetic
KPIKEFLERLKSLIQKMIHQRLS

SEQ ID NO: 696 - protein, 23 aa, synthetic construct
  REGION 1..23: note = Synthetic
FVKRLLDEIKTCWNKILRGAKKH

SEQ ID NO: 697 - protein, 34 aa, synthetic construct
  REGION 1..34: note = Synthetic
KVFKKIEKMGRNIRNGIVKAGPAIAVLGEAKALG

SEQ ID NO: 698 - protein, 26 aa, synthetic construct
  REGION 1..26: note = Synthetic
EELFQQYGEVMQKIMQDLLMDTPAKE

SEQ ID NO: 699 - protein, 13 aa, synthetic construct
  REGION 1..13: note = Synthetic
LKGLFKKVASLLT

SEQ ID NO: 700 - protein, 13 aa, synthetic construct
  REGION 1..13: note = Synthetic
IGNVLGGLLKNLG

SEQ ID NO: 701 - protein, 39 aa, synthetic construct
  REGION 1..39: note = Synthetic
WIRDFGKRIERVGQHTRDATIQTIAVAQQAANVAATLKG

SEQ ID NO: 702 - protein, 19 aa, synthetic construct
  REGION 1..19: note = Synthetic
LLQKIKTCWNKILRGIKEH

SEQ ID NO: 703 - protein, 25 aa, synthetic construct
  REGION 1..25: note = Synthetic
MRFMRRLVRNLQYLLLPITSSLLFI

SEQ ID NO: 704 - protein, 19 aa, synthetic construct
  REGION 1..19: note = Synthetic
LLQKIKTCWNKILRGIKEH

SEQ ID NO: 705 - protein, 12 aa, synthetic construct
  REGION 1..12: note = Synthetic
LKSIVSWAKKVL

SEQ ID NO: 706 - protein, 31 aa, synthetic construct
  REGION 1..31: note = Synthetic
QQLRRLFDAARNLPNICNIPNIGACPFRAWP

SEQ ID NO: 707 - protein, 12 aa, synthetic construct
  REGION 1..12: note = Synthetic
LKAIAALVKKVL

SEQ ID NO: 708 - protein, 27 aa, synthetic construct
  REGION 1..27: note = Synthetic
LFQKIKRWWKRIFEHEASRSARRLRAV

SEQ ID NO: 709 - protein, 27 aa, synthetic construct
  REGION 1..27: note = Synthetic
LFQKIKRWWKRIFEHEASRSARRLRAV

SEQ ID NO: 710 - protein, 27 aa, synthetic construct
  REGION 1..27: note = Synthetic
LFQKIKRWWKRIFEHEASRSARRLRAV

SEQ ID NO: 711 - protein, 25 aa, synthetic construct
  REGION 1..25: note = Synthetic
ELLKAMDYILSRWGKYLKNRNKNNS

SEQ ID NO: 712 - protein, 23 aa, synthetic construct
  REGION 1..23: note = Synthetic
KPIKEFLERLKSLIQKMIHQHLS

SEQ ID NO: 713 - protein, 23 aa, synthetic construct
  REGION 1..23: note = Synthetic
KPIKEFLERLKSLIQKMIHQHLS

SEQ ID NO: 714 - protein, 20 aa, synthetic construct
  REGION 1..20: note = Synthetic
CNHMPNLLTRCLQRLKRLKS

SEQ ID NO: 715 - protein, 12 aa, synthetic construct
  REGION 1..12: note = Synthetic
FKKIATVVKNLV

SEQ ID NO: 716 - protein, 12 aa, synthetic construct
  REGION 1..12: note = Synthetic
YIQLIRKILKSG

SEQ ID NO: 717 - protein, 12 aa, synthetic construct
  REGION 1..12: note = Synthetic
WKGIAAMAKKLL

SEQ ID NO: 718 - protein, 12 aa, synthetic construct
  REGION 1..12: note = Synthetic
WKGIAAMAKKLL

SEQ ID NO: 719 - protein, 13 aa, synthetic construct
  REGION 1..13: note = Synthetic
WKKIKSIIKAAMN

SEQ ID NO: 720 - protein, 23 aa, synthetic construct
  REGION 1..23: note = Synthetic
KEFKRIVQRIKDFLQHLVPRTEA

SEQ ID NO: 721 - protein, 34 aa, synthetic construct
  REGION 1..34: note = Synthetic
KVFKKIEKVGRNVRDGIIKAGPAIGVLGQAKALG

SEQ ID NO: 722 - protein, 33 aa, synthetic construct
  REGION 1..33: note = Synthetic
KIFKKIEKVGQNIRDGIVKAGPAVAVVGQAATI

SEQ ID NO: 723 - protein, 26 aa, synthetic construct
  REGION 1..26: note = Synthetic
VKELRRILDDWGEACKGCAEKSDFIR

SEQ ID NO: 724 - protein, 23 aa, synthetic construct
  REGION 1..23: note = Synthetic
FLKKLLQKIKTCWNKILRGIKEN

SEQ ID NO: 725 - protein, 15 aa, synthetic construct
  REGION 1..15: note = Synthetic
WKKIAEVGGKILSSL

SEQ ID NO: 726 - protein, 34 aa, synthetic construct
  REGION 1..34: note = Synthetic
LKKFGKKLEGVGKRVFKASEKALPVVTGFKALGK

SEQ ID NO: 727 - protein, 34 aa, synthetic construct
  REGION 1..34: note = Synthetic
LKKFGKKLEGVGKRVFKASEKALPVAVGIKALGK

SEQ ID NO: 728 - protein, 35 aa, synthetic construct
  REGION 1..35: note = Synthetic
KVFKKIEKVGRNIRDGVIKAGPAIAVVGQAKALGK

SEQ ID NO: 729 - protein, 11 aa, synthetic construct
  REGION 1..11: note = Synthetic
NALGGLIKKIG

SEQ ID NO: 730 - protein, 11 aa, synthetic construct
  REGION 1..11: note = Synthetic
NALGGLIKKIG

SEQ ID NO: 731 - protein, 11 aa, synthetic construct
  REGION 1..11: note = Synthetic
NALGGLIKKIG

SEQ ID NO: 732 - protein, 11 aa, synthetic construct
  REGION 1..11: note = Synthetic
NALGGLIKKIG

SEQ ID NO: 733 - protein, 11 aa, synthetic construct
  REGION 1..11: note = Synthetic
NALGGLIKKIG

SEQ ID NO: 734 - protein, 11 aa, synthetic construct
  REGION 1..11: note = Synthetic
NALGGLIKKIG

SEQ ID NO: 735 - protein, 11 aa, synthetic construct
  REGION 1..11: note = Synthetic
NALGGLIKKIG

SEQ ID NO: 736 - protein, 11 aa, synthetic construct
  REGION 1..11: note = Synthetic
NALGGLIKKIG

SEQ ID NO: 737 - protein, 11 aa, synthetic construct
  REGION 1..11: note = Synthetic
NALGGLIKKIG

SEQ ID NO: 738 - protein, 11 aa, synthetic construct
  REGION 1..11: note = Synthetic
NALGGLIKKIG

SEQ ID NO: 739 - protein, 11 aa, synthetic construct
  REGION 1..11: note = Synthetic
NALGGLIKKIG

SEQ ID NO: 740 - protein, 11 aa, synthetic construct
  REGION 1..11: note = Synthetic
NALGGLIKKIG

SEQ ID NO: 741 - protein, 27 aa, synthetic construct
  REGION 1..27: note = Synthetic
LWQRFLRWWNRLFHVSSNRLLREGGKK

SEQ ID NO: 742 - protein, 27 aa, synthetic construct
  REGION 1..27: note = Synthetic
LWQRFLRWWNRLFHVSSNRLLREGGKK

SEQ ID NO: 743 - protein, 11 aa, synthetic construct
  REGION 1..11: note = Synthetic
NAIGGLIKKIG

SEQ ID NO: 744 - protein, 39 aa, synthetic construct
  REGION 1..39: note = Synthetic
WLKKIGKKIERVGQNTRDATVKGLEVAQQAANVAATVRG

SEQ ID NO: 745 - protein, 27 aa, synthetic construct
  REGION 1..27: note = Synthetic
LFQKIKRWWKRIFEHEASRSARRLRAV

SEQ ID NO: 746 - protein, 27 aa, synthetic construct
  REGION 1..27: note = Synthetic
LFQKIKRWWKRIFEHEASRSARRLRAV

SEQ ID NO: 747 - protein, 12 aa, synthetic construct
  REGION 1..12: note = Synthetic
IAGGIASLVKNL

SEQ ID NO: 748 - protein, 34 aa, synthetic construct
  REGION 1..34: note = Synthetic
LKKLGKKLEGVGKRVFKASEKALPVAVGIKALGK

SEQ ID NO: 749 - protein, 11 aa, synthetic construct
  REGION 1..11: note = Synthetic
KYIKNLGKKIG

SEQ ID NO: 750 - protein, 19 aa, synthetic construct
  REGION 1..19: note = Synthetic
SIKSLLQKLIEFMKSLFKM

SEQ ID NO: 751 - protein, 37 aa, synthetic construct
  REGION 1..37: note = Synthetic
LKSFARVLKKVLPKAAKAGKALAKSMADENAIRQQNQ

SEQ ID NO: 752 - protein, 16 aa, synthetic construct
  REGION 1..16: note = Synthetic
KLIDTVIKQLRNLIAT

SEQ ID NO: 753 - protein, 24 aa, synthetic construct
  REGION 1..24: note = Synthetic
KLIKTFLEFISLLINSFAMGDLKY

SEQ ID NO: 754 - protein, 20 aa, synthetic construct
  REGION 1..20: note = Synthetic
FLKTLLQKIKTCWNKILRGH

SEQ ID NO: 755 - protein, 33 aa, synthetic construct
  REGION 1..33: note = Synthetic
LKKLGKKIEGAGKRVFKAAEKALPVVAGVKALG

SEQ ID NO: 756 - protein, 12 aa, synthetic construct
  REGION 1..12: note = Synthetic
FRKIATVVKNVV

SEQ ID NO: 757 - protein, 39 aa, synthetic construct
  REGION 1..39: note = Synthetic
WLKKIGKKIERVGQHTRDATIQTIGVAQQAANVAATLKG

SEQ ID NO: 758 - protein, 14 aa, synthetic construct
  REGION 1..14: note = Synthetic
AVDTLARLMHRALQ

SEQ ID NO: 759 - protein, 31 aa, synthetic construct
  REGION 1..31: note = Synthetic
LWKTIIKGAGKMIGSLAKNLLGSQAQPESEQ

SEQ ID NO: 760 - protein, 22 aa, synthetic construct
  REGION 1..22: note = Synthetic
ALSRLKAALQDMLRQLDRNPGC

SEQ ID NO: 761 - protein, 22 aa, synthetic construct
  REGION 1..22: note = Synthetic
ALSRLKAALQDMLRQLDRNPGC

SEQ ID NO: 762 - protein, 23 aa, synthetic construct
  REGION 1..23: note = Synthetic
KEFKRIVQRIKDFLQHLVPRTEA

SEQ ID NO: 763 - protein, 26 aa, synthetic construct
  REGION 1..26: note = Synthetic
NWRKILGKIAKVAAGLLGSMLAGYQV

SEQ ID NO: 764 - protein, 34 aa, synthetic construct
  REGION 1..34: note = Synthetic
WVTDLMNLMDRLIKKCHETNFKAKHCKKLKNNSP

SEQ ID NO: 765 - protein, 15 aa, synthetic construct
  REGION 1..15: note = Synthetic
FKNLIRKCVDVARKV

SEQ ID NO: 766 - protein, 35 aa, synthetic construct
  REGION 1..35: note = Synthetic
KIFKKIERVGQNVRDGIIKAGPAIQVLGTAKALGK

SEQ ID NO: 767 - protein, 13 aa, synthetic construct
  REGION 1..13: note = Synthetic
CYNGLAKCCRPFW

SEQ ID NO: 768 - protein, 34 aa, synthetic construct
  REGION 1..34: note = Synthetic
IDEIKSFIRSCIDEFDKLHTDLYVKYEKISSEQK

SEQ ID NO: 769 - protein, 11 aa, synthetic construct
  REGION 1..11: note = Synthetic
NALGGLIKKIG

SEQ ID NO: 770 - protein, 11 aa, synthetic construct
  REGION 1..11: note = Synthetic
NALGGLIKKIG

SEQ ID NO: 771 - protein, 23 aa, synthetic construct
  REGION 1..23: note = Synthetic
KNVKKFIEKLRTFIRKLSRDARV

SEQ ID NO: 772 - protein, 21 aa, synthetic construct
  REGION 1..21: note = Synthetic
FLNALKNFAKTAGKRLKSLLN

SEQ ID NO: 773 - protein, 13 aa, synthetic construct
  REGION 1..13: note = Synthetic
RLWELINSLLQQE

SEQ ID NO: 774 - protein, 12 aa, synthetic construct
  REGION 1..12: note = Synthetic
KTLGKIAEKCDR

SEQ ID NO: 775 - protein, 14 aa, synthetic construct
  REGION 1..14: note = Synthetic
RRCLQLAHKVIRKL

SEQ ID NO: 776 - protein, 29 aa, synthetic construct
  REGION 1..29: note = Synthetic
LFHTFEKFVKDMVKSATGSGSRRRRKKKP

SEQ ID NO: 777 - protein, 27 aa, synthetic construct
  REGION 1..27: note = Synthetic
LWQRFLRWWNRLFHVSSNRLLREGGKK

SEQ ID NO: 778 - protein, 36 aa, synthetic construct
  REGION 1..36: note = Synthetic
KFFKKIEKVGQNIRDGIIKAGPAVAVVGQAASITGK

SEQ ID NO: 779 - protein, 39 aa, synthetic construct
  REGION 1..39: note = Synthetic
WLKKIGKKIERVGQHTRDATIQGLGVAQQAPNVAATARG

SEQ ID NO: 780 - protein, 13 aa, synthetic construct
  REGION 1..13: note = Synthetic
FLGTLINLAKKIM

SEQ ID NO: 781 - protein, 34 aa, synthetic construct
  REGION 1..34: note = Synthetic
LKKLGKKLEGVGKRVFKASEKALPVLTGYKAIGK

SEQ ID NO: 782 - protein, 34 aa, synthetic construct; identical to SEQ ID NO: 781
  REGION 1..34: note = Synthetic

SEQ ID NO: 783 - protein, 35 aa, synthetic construct
  REGION 1..35: note = Synthetic
KFFKKIERVGQNVRDGLIKAGPAIQVLGAAKALGK

SEQ ID NO: 784 - protein, 24 aa, synthetic construct
  REGION 1..24: note = Synthetic
GRRLGEKIERIGQKIKDLSEFFQS

SEQ ID NO: 785 - protein, 14 aa, synthetic construct
  REGION 1..14: note = Synthetic
DLIRKAVAAIKNIV

SEQ ID NO: 786 - protein, 13 aa, synthetic construct
  REGION 1..13: note = Synthetic
VGEPLGGLIKKIG

SEQ ID NO: 787 - protein, 23 aa, synthetic construct
  REGION 1..23: note = Synthetic
ARSWASMAKKLKEYMEKLKQRAG

SEQ ID NO: 788 - protein, 30 aa, synthetic construct
  REGION 1..30: note = Synthetic
RALSRAARSIWDALKKISGFSGTSGKKIRY

SEQ ID NO: 789 - protein, 11 aa, synthetic construct
  REGION 1..11: note = Synthetic
NALGGLLKNIG

SEQ ID NO: 790 - protein, 11 aa, synthetic construct
  REGION 1..11: note = Synthetic
NALGGLLKNIG

SEQ ID NO: 791 - protein, 11 aa, synthetic construct
  REGION 1..11: note = Synthetic
NALGGLLKNIG

SEQ ID NO: 792 - protein, 22 aa, synthetic construct
  REGION 1..22: note = Synthetic
RIVDNIISVFRQLCEDCLVFLV

SEQ ID NO: 793 - protein, 35 aa, synthetic construct
  REGION 1..35: note = Synthetic
GFGTILKALAKIAGKVVKKLATKPGATYMLKQNLQ

SEQ ID NO: 794 - protein, 23 aa, synthetic construct
  REGION 1..23: note = Synthetic
ELITFMKNLLDHLRRIYRYRSVN

SEQ ID NO: 795 - protein, 15 aa, synthetic construct
  REGION 1..15: note = Synthetic
ITDILAKLGKVLAHV

SEQ ID NO: 796 - protein, 21 aa, synthetic construct
  REGION 1..21: note = Synthetic
EVAQFVKDLLRHLKRLYRHRV

SEQ ID NO: 797 - protein, 19 aa, synthetic construct
  REGION 1..19: note = Synthetic
LLQKIKTCWNKILRGITEH

SEQ ID NO: 798 - protein, 33 aa, synthetic construct
  REGION 1..33: note = Synthetic
KKLGKKIEKAGKRVFNAAQKGLPVAAGVQALGR

SEQ ID NO: 799 - protein, 12 aa, synthetic construct
  REGION 1..12: note = Synthetic
WKKLLDAAKQIL

SEQ ID NO: 800 - protein, 16 aa, synthetic construct
  REGION 1..16: note = Synthetic
MGKFARRFCKFMCGFC

SEQ ID NO: 801 - protein, 24 aa, synthetic construct
  REGION 1..24: note = Synthetic
EVAQFIKDLLRHLKKRFRDANVKA

SEQ ID NO: 802 - protein, 12 aa, synthetic construct
  REGION 1..12: note = Synthetic
SIVEGIAKAIRE

SEQ ID NO: 803 - protein, 17 aa, synthetic construct
  REGION 1..17: note = Synthetic
VIKTIGGVIGGLLKNLG

SEQ ID NO: 804 - protein, 26 aa, synthetic construct
  REGION 1..26: note = Synthetic
FQRLVREIAQDFKDIQLARRIRGDRA

SEQ ID NO: 805 - protein, 23 aa, synthetic construct
  REGION 1..23: note = Synthetic
KNVKKFIEKLRTFIRKLSRDARV

SEQ ID NO: 806 - protein, 23 aa, synthetic construct
  REGION 1..23: note = Synthetic
KNVKKFIEKLRTFIRKLSRDARV

SEQ ID NO: 807 - protein, 12 aa, synthetic construct
  REGION 1..12: note = Synthetic
LKAIAAFAKKLL

SEQ ID NO: 808 - protein, 18 aa, synthetic construct
  REGION 1..18: note = Synthetic
IIKVITRALRGARRLLKY

SEQ ID NO: 809 - protein, 12 aa, synthetic construct
  REGION 1..12: note = Synthetic
IATGIASLVKNL

SEQ ID NO: 810 - protein, 26 aa, synthetic construct
  REGION 1..26: note = Synthetic
LLRALDTVATCWEKLFALRASASRKS

SEQ ID NO: 811 - protein, 30 aa, synthetic construct
  REGION 1..30: note = Synthetic
RAWLDKLKNLGKVVGKVALGVVQNYLNPRQ

SEQ ID NO: 812 - protein, 11 aa, synthetic construct
  REGION 1..11: note = Synthetic
NALGGLLKNLG

SEQ ID NO: 813 - protein, 12 aa, synthetic construct
  REGION 1..12: note = Synthetic
LKAIAALAKKLL

SEQ ID NO: 814 - protein, 36 aa, synthetic construct
  REGION 1..36: note = Synthetic
KLFKKIEKVGQNIRDGIIKAGPAVAVVGQATQIAKG

SEQ ID NO: 815 - protein, 28 aa, synthetic construct
  REGION 1..28: note = Synthetic
LWQRFLRWWNRLFTGSAANSTRTLRTDN

SEQ ID NO: 816 - protein, 28 aa, synthetic construct
  REGION 1..28: note = Synthetic
LWQRFLRWWNRLFTGSAANSTRTLRTDN

SEQ ID NO: 817 - protein, 28 aa, synthetic construct
  REGION 1..28: note = Synthetic
LWQRFLRWWNRLFTGSAANSTRTLRTDN

SEQ ID NO: 818 - protein, 12 aa, synthetic construct
  REGION 1..12: note = Synthetic
LKALAALAKKIL

SEQ ID NO: 819 - protein, 12 aa, synthetic construct
  REGION 1..12: note = Synthetic
LKALLAVAKKIL

SEQ ID NO: 820 - protein, 35 aa, synthetic construct
  REGION 1..35: note = Synthetic
KVFKKIEKVGRHIRDGVIKAGPAITVVGQATALGK

SEQ ID NO: 821 - protein, 17 aa, synthetic construct
  REGION 1..17: note = Synthetic
VIKTIGGVLGGLLKNLG

SEQ ID NO: 822 - protein, 35 aa, synthetic construct
  REGION 1..35: note = Synthetic
GFGTILKALAKIAGKVVKKLATKPGATYMLKENLK

SEQ ID NO: 823 - protein, 35 aa, synthetic construct
  REGION 1..35: note = Synthetic
AFGTILKALAKIAAKVVKKLATKPGATYMLKQNLQ

SEQ ID NO: 824 - protein, 24 aa, synthetic construct
  REGION 1..24: note = Synthetic
LSRVWNNLSNLVQSSGKAREKGTL

SEQ ID NO: 825 - protein, 16 aa, synthetic construct
  REGION 1..16: note = Synthetic
FSDMATYCRRLIESLS

SEQ ID NO: 826 - protein, 33 aa, synthetic construct
  REGION 1..33: note = Synthetic
KVFKKIEKVGRNIRDGVIKAAPAIEVLGQAKAL

SEQ ID NO: 827 - protein, 15 aa, synthetic construct
  REGION 1..15: note = Synthetic
LSRILSTVIRTCYYL

SEQ ID NO: 828 - protein, 16 aa, synthetic construct
  REGION 1..16: note = Synthetic
ISKIGGVLGGLLKNLG

SEQ ID NO: 829 - protein, 16 aa, synthetic construct
  REGION 1..16: note = Synthetic
ISKIGGVLGGLLKNLG

SEQ ID NO: 830 - protein, 16 aa, synthetic construct
  REGION 1..16: note = Synthetic
ISKIGGVLGGLLKNLG

SEQ ID NO: 831 - protein, 35 aa, synthetic construct
  REGION 1..35: note = Synthetic
AFGTILKALAKIAGKVVKKLATKPGATYMLKENLQ

SEQ ID NO: 832 - protein, 13 aa, synthetic construct
  REGION 1..13: note = Synthetic
CRRYCRRITDACV

SEQ ID NO: 833 - protein, 15 aa, synthetic construct
  REGION 1..15: note = Synthetic
IMDILAKLGKVLAHV

SEQ ID NO: 834 - protein, 19 aa, synthetic construct
  REGION 1..19: note = Synthetic
MEKFLSDLHRLLQQLVKEK

SEQ ID NO: 835 - protein, 30 aa, synthetic construct
  REGION 1..30: note = Synthetic
MVKNMTDVLTTMTKLIKDVPRKNLIYVRLY

SEQ ID NO: 836 - protein, 15 aa, synthetic construct
  REGION 1..15: note = Synthetic
WKKIAEIGKQVLSAL

SEQ ID NO: 837 - protein, 30 aa, synthetic construct
  REGION 1..30: note = Synthetic
KAGEKIVRGLKNIGQRIKDFFGKLTPRTES

SEQ ID NO: 838 - protein, 13 aa, synthetic construct
  REGION 1..13: note = Synthetic
IGGVLGGLLKNLG

SEQ ID NO: 839 - protein, 13 aa, synthetic construct
  REGION 1..13: note = Synthetic
IGGVLGGLLKNLG

SEQ ID NO: 840 - protein, 13 aa, synthetic construct
  REGION 1..13: note = Synthetic
IGGVLGGLLKNLG

SEQ ID NO: 841 - protein, 13 aa, synthetic construct
  REGION 1..13: note = Synthetic
IGGVLGGLLKNLG

SEQ ID NO: 842 - protein, 11 aa, synthetic construct
  REGION 1..11: note = Synthetic
AVKKYLNSILN

SEQ ID NO: 843 - protein, 11 aa, synthetic construct
  REGION 1..11: note = Synthetic
AVKKYLNSILN

SEQ ID NO: 844 - protein, 11 aa, synthetic construct
  REGION 1..11: note = Synthetic
AVKKYLNSILN

SEQ ID NO: 845 - protein, 11 aa, synthetic construct
  REGION 1..11: note = Synthetic
AVKKYLNSILN

SEQ ID NO: 846 - protein, 15 aa, synthetic construct
  REGION 1..15: note = Synthetic
ILTTLANWARKFLGK

SEQ ID NO: 847 - protein, 11 aa, synthetic construct
  REGION 1..11: note = Synthetic
NALGGLLKNLG

SEQ ID NO: 848 - protein, 11 aa, synthetic construct
  REGION 1..11: note = Synthetic
NALGGLLKNLG

SEQ ID NO: 849 - protein, 16 aa, synthetic construct
  REGION 1..16: note = Synthetic
KIKTCWNKILRGIKEH

SEQ ID NO: 850 - protein, 16 aa, synthetic construct
  REGION 1..16: note = Synthetic
KIKTCWNKILRGIKEH

SEQ ID NO: 851 - protein, 35 aa, synthetic construct
  REGION 1..35: note = Synthetic
QICNTLSRVISSLTKSMHAVGCGDRRRSTHRSDEL

SEQ ID NO: 852 - protein, 26 aa, synthetic construct
  REGION 1..26: note = Synthetic
FFENIINLLDRLISTNPKVHQRLRYR

SEQ ID NO: 853 - protein, 19 aa, synthetic construct
  REGION 1..19: note = Synthetic
LLQKIKTCWNKILRGSKEH

SEQ ID NO: 854 - protein, 12 aa, synthetic construct
  REGION 1..12: note = Synthetic
WLKLGKAIIDAL

SEQ ID NO: 855 - protein, 29 aa, synthetic construct
  REGION 1..29: note = Synthetic
KLFDVLKKIIKVIVMVVDSTKANEERQKT

SEQ ID NO: 856 - protein, 25 aa, synthetic construct
  REGION 1..25: note = Synthetic
WMTLLKKVLKAAAKALNAVLVGANA

SEQ ID NO: 857 - protein, 12 aa, synthetic construct
  REGION 1..12: note = Synthetic
WKKMAATALKMI

SEQ ID NO: 858 - protein, 29 aa, synthetic construct
  REGION 1..29: note = Synthetic
RAWLDKLKSIGKVVGKVAIGVAKNLLNPQ

SEQ ID NO: 859 - protein, 12 aa, synthetic construct
  REGION 1..12: note = Synthetic
LKAIAAMAKKLL

SEQ ID NO: 860 - protein, 19 aa, synthetic construct
  REGION 1..19: note = Synthetic
GTLFDILKKVVEVIIKVVV

SEQ ID NO: 861 - protein, 14 aa, synthetic construct
  REGION 1..14: note = Synthetic
TEFLKSFTKLITQV

SEQ ID NO: 862 - protein, 11 aa, synthetic construct
  REGION 1..11: note = Synthetic
LKTLQKLMENY

SEQ ID NO: 863 - protein, 11 aa, synthetic construct
  REGION 1..11: note = Synthetic
LKTLQKLMENY

SEQ ID NO: 864 - protein, 11 aa, synthetic construct
  REGION 1..11: note = Synthetic
LKTLQKLMENY

SEQ ID NO: 865 - protein, 39 aa, synthetic construct
  REGION 1..39: note = Synthetic
RDLKKILNDWDESCDGCLEKGDFIKRIEELKPKYSRSEL

SEQ ID NO: 866 - protein, 39 aa, synthetic construct; identical to SEQ ID NO: 865
  REGION 1..39: note = Synthetic

SEQ ID NO: 867 - protein, 39 aa, synthetic construct; identical to SEQ ID NO: 865
  REGION 1..39: note = Synthetic

SEQ ID NO: 868 - protein, 39 aa, synthetic construct; identical to SEQ ID NO: 865
  REGION 1..39: note = Synthetic

SEQ ID NO: 869 - protein, 39 aa, synthetic construct; identical to SEQ ID NO: 865
  REGION 1..39: note = Synthetic

SEQ ID NO: 870 - protein, 23 aa, synthetic construct
  REGION 1..23: note = Synthetic
EVAQFVKDLLRHLRKLFHQGKFN

SEQ ID NO: 871 - protein, 13 aa, synthetic construct
  REGION 1..13: note = Synthetic
WKKIKSLIKAAMS

SEQ ID NO: 872 - protein, 15 aa, synthetic construct
  REGION 1..15: note = Synthetic
ILNTIINLAKKILGK

SEQ ID NO: 873 - protein, 12 aa, synthetic construct
  REGION 1..12: note = Synthetic
MLAKLGKVLAHV

SEQ ID NO: 874 - protein, 39 aa, synthetic construct
  REGION 1..39: note = Synthetic
RDLKKILNDWDESCDGCLEKTDFIKRIEELKPKYSRNEL

SEQ ID NO: 875 - protein, 39 aa, synthetic construct
  REGION 1..39: note = Synthetic
RDLKKILNDWDESCDGCLEKSDFIKRIEELKPKYSRNEL

SEQ ID NO: 876 - protein, 39 aa, synthetic construct
  REGION 1..39: note = Synthetic
RDLKKILNDWDESCDGCLEKSDFIKRIEELKPKYAHNEL

SEQ ID NO: 877 - protein, 22 aa, synthetic construct
  REGION 1..22: note = Synthetic
DKVKSMGEKLKQYIQTWKAKFG

SEQ ID NO: 878 - protein, 11 aa, synthetic construct
  REGION 1..11: note = Synthetic
SALGGLLKKIG

SEQ ID NO: 879 - protein, 11 aa, synthetic construct
  REGION 1..11: note = Synthetic
SALGGLLKKIG

SEQ ID NO: 880 - protein, 11 aa, synthetic construct
  REGION 1..11: note = Synthetic
SALGGLLKKIG

SEQ ID NO: 881 - protein, 23 aa, synthetic construct
  REGION 1..23: note = Synthetic
FQEYGAVLQKILQDVLGDTATAE

SEQ ID NO: 882 - protein, 12 aa, synthetic construct
  REGION 1..12: note = Synthetic
FVKTVAGHIANI

SEQ ID NO: 883 - protein, 30 aa, synthetic construct
  REGION 1..30: note = Synthetic
QWLTSCWSTLMRLIHQMAGRYRGTPLCLLR

SEQ ID NO: 884 - protein, 33 aa, synthetic construct
  REGION 1..33: note = Synthetic
ILRKAGEKIGGGLKKIGQKIKDFFGKLAPRTES

SEQ ID NO: 885 - protein, 23 aa, synthetic construct
  REGION 1..23: note = Synthetic
FLKRLLQEIKTCWNKILSGTKEH

SEQ ID NO: 886 - protein, 16 aa, synthetic construct
  REGION 1..16: note = Synthetic
NILNTIINLAKKILGK

SEQ ID NO: 887 - protein, 23 aa, synthetic construct
  REGION 1..23: note = Synthetic
NCCRKMTRLLKELLQISEMKSVW

SEQ ID NO: 888 - protein, 32 aa, synthetic construct
  REGION 1..32: note = Synthetic
LRKGGRCWNRCIGNTRQIGSCGVPFLKCCKRK

SEQ ID NO: 889 - protein, 25 aa, synthetic construct
  REGION 1..25: note = Synthetic
ENIRRVFNDCRDIIQRMHLRQYELL

SEQ ID NO: 890 - protein, 11 aa, synthetic construct
  REGION 1..11: note = Synthetic
SALGGLIKKIG

SEQ ID NO: 891 - protein, 11 aa, synthetic construct
  REGION 1..11: note = Synthetic
SALGGLIKKIG

SEQ ID NO: 892 - protein, 11 aa, synthetic construct
  REGION 1..11: note = Synthetic
SALGGLIKKIG

SEQ ID NO: 893 - protein, 11 aa, synthetic construct
  REGION 1..11: note = Synthetic
SALGGLIKKIG

SEQ ID NO: 894 - protein, 11 aa, synthetic construct
  REGION 1..11: note = Synthetic
SALGGLIKKIG

SEQ ID NO: 895 - protein, 35 aa, synthetic construct
  REGION 1..35: note = Synthetic
LSDAMQRIKTMFRNWYQKRRDIRRREGNKGSDSGV

SEQ ID NO: 896 - protein, 37 aa, synthetic construct
  REGION 1..37: note = Synthetic
IGAIKKAGKAIGKGLRAVNIASTAHDVYTFFKPKKRH

SEQ ID NO: 897 - protein, 30 aa, synthetic construct
  REGION 1..30: note = Synthetic
LTEMMKTIKYLIKYLIKKAERNLLYRFFIT

SEQ ID NO: 898 - protein, 23 aa, synthetic construct
  REGION 1..23: note = Synthetic
ALWKNMLKGIGKLAGKAALGAVK

SEQ ID NO: 899 - protein, 40 aa, synthetic construct
  REGION 1..40: note = Synthetic
NSLKEFGNNLKDTFESIPEATRKLMTSFAERLKNFRIPLL

SEQ ID NO: 900 - protein, 23 aa, synthetic construct
  REGION 1..23: note = Synthetic
EVIQLVKNLLNHLRRNFRHGNFK

SEQ ID NO: 901 - protein, 19 aa, synthetic construct
  REGION 1..19: note = Synthetic
GIIDIAKKLVGGIRNVLGI

SEQ ID NO: 902 - protein, 40 aa, synthetic construct
  REGION 1..40: note = Synthetic
VKELKNILGEWGEVCKGCTEKAELIKRIEELKPKYVKEEL

SEQ ID NO: 903 - protein, 19 aa, synthetic construct
  REGION 1..19: note = Synthetic
GILDIAKKLVGGIRNVLGI

SEQ ID NO: 904 - protein, 12 aa, synthetic construct
  REGION 1..12: note = Synthetic
CWNKILRGAKEY

SEQ ID NO: 905 - protein, 17 aa, synthetic construct
  REGION 1..17: note = Synthetic
IGKIGDFIKKAIAKYKN

SEQ ID NO: 906 - protein, 15 aa, synthetic construct
  REGION 1..15: note = Synthetic
KLAAKLKKVIQQLWE

SEQ ID NO: 907 - protein, 39 aa, synthetic construct
  REGION 1..39: note = Synthetic
KHFNKLVKKVKHTISETAHVAKDTAVIAGSGAAVVAATG

SEQ ID NO: 908 - protein, 23 aa, synthetic construct
  REGION 1..23: note = Synthetic
LNALKKVFQGIHEAIKLINNHVQ

SEQ ID NO: 909 - protein, 30 aa, synthetic construct
  REGION 1..30: note = Synthetic
RAWLDKLKSLGKVVGKVGLGVVQNYLNPRQ

SEQ ID NO: 910 - protein, 20 aa, synthetic construct
  REGION 1..20: note = Synthetic
TQAWTNFKKWFKKWFKKTFS

SEQ ID NO: 911 - protein, 20 aa, synthetic construct
  REGION 1..20: note = Synthetic
TQAWTNFKKWFKKWFKKTFS

SEQ ID NO: 912 - protein, 20 aa, synthetic construct
  REGION 1..20: note = Synthetic
TQAWTNFKKWFKKWFKKTFS

SEQ ID NO: 913 - protein, 20 aa, synthetic construct
  REGION 1..20: note = Synthetic
TQAWTNFKKWFKKWFKKTFS

SEQ ID NO: 914 - protein, 24 aa, synthetic construct
  REGION 1..24: note = Synthetic
LVDGASDVLDRVMKALDNVDKKYN

SEQ ID NO: 915 - protein, 12 aa, synthetic construct
  REGION 1..12: note = Synthetic
KIVQKMLKGVPK

SEQ ID NO: 916 - protein, 12 aa, synthetic construct
  REGION 1..12: note = Synthetic
KIVQKMLKGVPK

SEQ ID NO: 917 - protein, 18 aa, synthetic construct
  REGION 1..18: note = Synthetic
ARRFSTLFRHLIKMIMFV

SEQ ID NO: 918 - protein, 34 aa, synthetic construct
  REGION 1..34: note = Synthetic
LKKLGKKLEGAGKRVFNAAEKALPVVAGAKALGK

SEQ ID NO: 919 - protein, 34 aa, synthetic construct; identical to SEQ ID NO: 918
  REGION 1..34: note = Synthetic

SEQ ID NO: 920 - protein, 34 aa, synthetic construct; identical to SEQ ID NO: 918
  REGION 1..34: note = Synthetic

SEQ ID NO: 921 - protein, 11 aa, synthetic construct
  REGION 1..11: note = Synthetic
SALGGLIKKIG

SEQ ID NO: 922 - protein, 11 aa, synthetic construct
  REGION 1..11: note = Synthetic
SALGGLIKKIG

SEQ ID NO: 923 - protein, 11 aa, synthetic construct
  REGION 1..11: note = Synthetic
SALGGLIKKIG

SEQ ID NO: 924 - protein, 11 aa, synthetic construct
  REGION 1..11: note = Synthetic
SALGGLIKKIG

SEQ ID NO: 925 - protein, 11 aa, synthetic construct
  REGION 1..11: note = Synthetic
SALGGLIKKIG

SEQ ID NO: 926 - protein, 17 aa, synthetic construct
  REGION 1..17: note = Synthetic
LRRICGVVSGILDRLVE

SEQ ID NO: 927 - protein, 23 aa, synthetic construct
  REGION 1..23: note = Synthetic
EVAQFVKDLLRHLRKLFHQGTFN

SEQ ID NO: 928 - protein, 12 aa, synthetic construct
  REGION 1..12: note = Synthetic
IHKVVSAIKNVA

SEQ ID NO: 929 - protein, 16 aa, synthetic construct
  REGION 1..16: note = Synthetic
MLRDLRDAFSRVKTFF

SEQ ID NO: 930 - protein, 16 aa, synthetic construct
  REGION 1..16: note = Synthetic
MLRDLRDAFSRVKTFF

SEQ ID NO: 931 - protein, 16 aa, synthetic construct
  REGION 1..16: note = Synthetic
MLRDLRDAFSRVKTFF

SEQ ID NO: 932 - protein, 15 aa, synthetic construct
  REGION 1..15: note = Synthetic
VVDEIEELVQELSDV

SEQ ID NO: 933 - protein, 23 aa, synthetic construct
  REGION 1..23: note = Synthetic
LNTLKKVFQGLHEAIKLINNHVQ

SEQ ID NO: 934 - protein, 12 aa, synthetic construct
  REGION 1..12: note = Synthetic
SIVEGIAKAIRE

SEQ ID NO: 935 - protein, 30 aa, synthetic construct
  REGION 1..30: note = Synthetic
DCYRRFEKGVEKGQKCWRIPTGLRYSKEKE

SEQ ID NO: 936 - protein, 12 aa, synthetic construct
  REGION 1..12: note = Synthetic
NILEQYLKNMQN

SEQ ID NO: 937 - protein, 12 aa, synthetic construct
  REGION 1..12: note = Synthetic
NILEQYLKNMQN

SEQ ID NO: 938 - protein, 14 aa, synthetic construct
  REGION 1..14: note = Synthetic
DAAKKVVNVLKNLP

SEQ ID NO: 939 - protein, 28 aa, synthetic construct
  REGION 1..28: note = Synthetic
GRKYLKNVLKKLNRLKEKNKAKNSKENN

SEQ ID NO: 940 - protein, 39 aa, synthetic construct
  REGION 1..39: note = Synthetic
RDLKKILNDWDESCDGCLEKSDFIKRIEELKPKYAHGEL

SEQ ID NO: 941 - protein, 39 aa, synthetic construct
  REGION 1..39: note = Synthetic
RDLKKILNDWDESCDGCLEKSDFIKRIEELKPKYARSEL

SEQ ID NO: 942 - protein, 39 aa, synthetic construct; identical to SEQ ID NO: 941
  REGION 1..39: note = Synthetic

SEQ ID NO: 943 - protein, 19 aa, synthetic construct
  REGION 1..19: note = Synthetic
KFLDSFMRHMCTVCRNMHI

SEQ ID NO: 944 - protein, 23 aa, synthetic construct
  REGION 1..23: note = Synthetic
NKIRNIGGKVENPWKSQIRDWKN

SEQ ID NO: 945 - protein, 32 aa, synthetic construct
  REGION 1..32: note = Synthetic
KSFSSICKELCKLCQRCNPASNRRHGYWDHWW

SEQ ID NO: 946 - protein, 23 aa, synthetic construct
  REGION 1..23: note = Synthetic
EVAQFVKDLLRHLRKLFHQGTFN

SEQ ID NO: 947 - protein, 30 aa, synthetic construct
  REGION 1..30: note = Synthetic
RAWLDKLKSLGKVVGKVALGVAQNYLNPQQ

SEQ ID NO: 948 - protein, 30 aa, synthetic construct
  REGION 1..30: note = Synthetic
RAWLDKLKSLGKVVGKVAIGVAQHYLNPQQ

SEQ ID NO: 949 - protein, 22 aa, synthetic construct
  REGION 1..22: note = Synthetic
INTLKKVIQGLHEVIKLVSNHA

SEQ ID NO: 950 - protein, 17 aa, synthetic construct
  REGION 1..17: note = Synthetic
LVDVLGKVGGLIKKLLP

SEQ ID NO: 951 - protein, 16 aa, synthetic construct
  REGION 1..16: note = Synthetic
KIKTCWNKILRGITEH

SEQ ID NO: 952 - protein, 12 aa, synthetic construct
  REGION 1..12: note = Synthetic
WKKIGQHILSVL

SEQ ID NO: 953 - protein, 29 aa, synthetic construct
  REGION 1..29: note = Synthetic
LFKTLIKGAGKMLGHVAKQFLGSQGQPES

SEQ ID NO: 954 - protein, 38 aa, synthetic construct
  REGION 1..38: note = Synthetic
RGILDTLKQFAKGVGKDLVKGAAQGVLSTVSCKLAKTC

SEQ ID NO: 955 - protein, 15 aa, synthetic construct
  REGION 1..15: note = Synthetic
ADKCLRYLLKNIKNA

SEQ ID NO: 956 - protein, 19 aa, synthetic construct
  REGION 1..19: note = Synthetic
EVIKKFTKAMEKMKKNGRA

SEQ ID NO: 957 - protein, 19 aa, synthetic construct
  REGION 1..19: note = Synthetic
EVIKKFTKAMEKMKKNGRA

SEQ ID NO: 958 - protein, 19 aa, synthetic construct
  REGION 1..19: note = Synthetic
EVIKKFTKAMEKMKKNGRA

SEQ ID NO: 959 - protein, 12 aa, synthetic construct
  REGION 1..12: note = Synthetic
FLSALLGMLKNL

SEQ ID NO: 960 - protein, 20 aa, synthetic construct
  REGION 1..20: note = Synthetic
KEVIKKFTKAMEKMKKNGRA

SEQ ID NO: 961 - protein, 28 aa, synthetic construct
  REGION 1..28: note = Synthetic
QEFLNSFSKLMQKLFKNSTAERYGKSTI

SEQ ID NO: 962 - protein, 19 aa, synthetic construct
  REGION 1..19: note = Synthetic
NFIKRINDFLKKAKSPPSP

SEQ ID NO: 963 - protein, 16 aa, synthetic construct
  REGION 1..16: note = Synthetic
DKFNDCLNEMRRLIKL

SEQ ID NO: 964 - protein, 32 aa, synthetic construct; identical to SEQ ID NO: 945
  REGION 1..32: note = Synthetic

SEQ ID NO: 965 - protein, 13 aa, synthetic construct
  REGION 1..13: note = Synthetic
FISAIASFLGKFL

SEQ ID NO: 966 - protein, 30 aa, synthetic construct
  REGION 1..30: note = Synthetic
ALWKNMLKGIGKLAGKAALGAVKKLVGAES

SEQ ID NO: 967 - protein, 13 aa, synthetic construct
  REGION 1..13: note = Synthetic
EFFRQWWDIIQSK

SEQ ID NO: 968 - protein, 12 aa, synthetic construct
  REGION 1..12: note = Synthetic
ILGTILGLLKSL

SEQ ID NO: 969 - protein, 28 aa, synthetic construct
  REGION 1..28: note = Synthetic
QEFLNSFSKLMQKLFKNSTAERYGKSTI

SEQ ID NO: 970 - protein, 12 aa, synthetic construct
  REGION 1..12: note = Synthetic
ILGTILGLLKGL

SEQ ID NO: 971 - protein, 12 aa, synthetic construct
  REGION 1..12: note = Synthetic
ILGTILGLLKGL

SEQ ID NO: 972 - protein, 33 aa, synthetic construct
  REGION 1..33: note = Synthetic
  SITE 29: note = X - any amino acid
VKELKKILDDWGEMCKGCAEKSDYIRKIXELMP

SEQ ID NO: 973 - protein, 19 aa, synthetic construct
  REGION 1..19: note = Synthetic
LLQKIKTCWNKILRGSKEH

SEQ ID NO: 974 - protein, 23 aa, synthetic construct
  REGION 1..23: note = Synthetic
FLKRLLQKIKTCWNKILMGTKEH

SEQ ID NO: 975 - protein, 12 aa, synthetic construct
  REGION 1..12: note = Synthetic
EVFNKLKSLLEK

SEQ ID NO: 976 - protein, 12 aa, synthetic construct
  REGION 1..12: note = Synthetic
WLKLGKAVIDAL

SEQ ID NO: 977 - protein, 18 aa, synthetic construct
  REGION 1..18: note = Synthetic
GRHLLNELKKWPRWQPKP

SEQ ID NO: 978 - protein, 13 aa, synthetic construct
  REGION 1..13: note = Synthetic
LKAIAALAKKLLG

SEQ ID NO: 979 - protein, 21 aa, synthetic construct
  REGION 1..21: note = Synthetic
YNILECFYKCLDLVKKVLISH

SEQ ID NO: 980 - protein, 30 aa, synthetic construct
  REGION 1..30: note = Synthetic
RALLDKLKSLGKVVGKVALGVVQNYLNPRQ

SEQ ID NO: 981 - protein, 15 aa, synthetic construct
  REGION 1..15: note = Synthetic
LYQLVQTWPNWVKSP

SEQ ID NO: 982 - protein, 28 aa, synthetic construct
  REGION 1..28: note = Synthetic
ALWKNMLKGIGKLAGQAALGAVKTLVGA

SEQ ID NO: 983 - protein, 28 aa, synthetic construct
  REGION 1..28: note = Synthetic
ALWKNMLKGIGKLAGQAALGAVKTLVGA

SEQ ID NO: 984 - protein, 34 aa, synthetic construct
  REGION 1..34: note = Synthetic
RGILDTLKNLAKTAGKGILKSLVNTASCKLSGQC

SEQ ID NO: 985 - protein, 11 aa, synthetic construct
  REGION 1..11: note = Synthetic
VDEATRLMAQL

SEQ ID NO: 986 - protein, 20 aa, synthetic construct
  REGION 1..20: note = Synthetic
KWVDEVCRSLKKYICEFIIP

SEQ ID NO: 987 - protein, 20 aa, synthetic construct
  REGION 1..20: note = Synthetic
LKEALSRFKSWLKRTFGKKE

SEQ ID NO: 988 - protein, 20 aa, synthetic construct
  REGION 1..20: note = Synthetic
LKEALSRFKSWLKRTFGKKE

SEQ ID NO: 989 - protein, 20 aa, synthetic construct
  REGION 1..20: note = Synthetic
LKEALSRFKSWLKRTFGKKE

SEQ ID NO: 990 - protein, 13 aa, synthetic construct
  REGION 1..13: note = Synthetic
FISAIASMLGKFL

SEQ ID NO: 991 - protein, 19 aa, synthetic construct
  REGION 1..19: note = Synthetic
EVIKKFTKAMEKMKKNGRA

SEQ ID NO: 992 - protein, 19 aa, synthetic construct
  REGION 1..19: note = Synthetic
EVIKKFTKAMEKMKKNGRA

SEQ ID NO: 993 - protein, 19 aa, synthetic construct
  REGION 1..19: note = Synthetic
EVIKKFTKAMEKMKKNGRA

SEQ ID NO: 994 - protein, 19 aa, synthetic construct
  REGION 1..19: note = Synthetic
LLQKIKTCWNKILRGSKEH

SEQ ID NO: 995 - protein, 25 aa, synthetic construct
  REGION 1..25: note = Synthetic
LKKIDEVLEKLGKLFIQSGKIKNAF

SEQ ID NO: 996 - protein, 12 aa, synthetic construct
  REGION 1..12: note = Synthetic
IIKKVASVIGGL

SEQ ID NO: 997 - protein, 23 aa, synthetic construct
  REGION 1..23: note = Synthetic
FLKRLLQKIKTCWNKILMGTKEH

SEQ ID NO: 998 - protein, 23 aa, synthetic construct
  REGION 1..23: note = Synthetic
EVTRLAKDLLQQLRKGVRQGKFQ

SEQ ID NO: 999 - protein, 11 aa, synthetic construct
  REGION 1..11: note = Synthetic
FEKLFANMPDY

SEQ ID NO: 1000 - protein, 14 aa, synthetic construct
  REGION 1..14: note = Synthetic
FADLFGKVANLIKS

SEQ ID NO: 1001 - protein, 17 aa, synthetic construct
  REGION 1..17: note = Synthetic
FIEKLMTFIRKALKNAR

SEQ ID NO: 1002 - protein, 20 aa, synthetic construct
  REGION 1..20: note = Synthetic
LKEALSRFKSWLKRTFGKKE

SEQ ID NO: 1003 - protein, 13 aa, synthetic construct
  REGION 1..13: note = Synthetic
FLSAIASMLGKFL

SEQ ID NO: 1004 - protein, 17 aa, synthetic construct
  REGION 1..17: note = Synthetic
LFDIIKSAISIIVKAVE

SEQ ID NO: 1005 - protein, 19 aa, synthetic construct
  REGION 1..19: note = Synthetic
LLQKIKTCWNKILRGAKEY

SEQ ID NO: 1006 - protein, 19 aa, synthetic construct
  REGION 1..19: note = Synthetic
LLQKIKTCWNKILRDAKEH

SEQ ID NO: 1007 - protein, 34 aa, synthetic construct
  REGION 1..34: note = Synthetic
LFSFIHSFIRSALSFLTQTEENSIAARLYATAFQ

SEQ ID NO: 1008 - protein, 23 aa, synthetic construct
  REGION 1..23: note = Synthetic
FLKRLLQKIKTCWNKILMGTKEH

SEQ ID NO: 1009 - protein, 23 aa, synthetic construct
  REGION 1..23: note = Synthetic
FLKRLLQKIKTCWNKILMGTKEH

SEQ ID NO: 1010 - protein, 23 aa, synthetic construct
  REGION 1..23: note = Synthetic
FLKRLLQKIKTCWNKILMGTKEH

SEQ ID NO: 1011 - protein, 17 aa, synthetic construct
  REGION 1..17: note = Synthetic
RCVNNFDDVFNSVFRKL

SEQ ID NO: 1012 - protein, 12 aa, synthetic construct
  REGION 1..12: note = Synthetic
VGNFVHGFSHVF

SEQ ID NO: 1013 - protein, 23 aa, synthetic construct
  REGION 1..23: note = Synthetic
FLKRLLQKIKTCWNKILMGTKEH

SEQ ID NO: 1014 - protein, 25 aa, synthetic construct
  REGION 1..25: note = Synthetic
ARLTKLAEQLMEKIKNLCYTKVLGY

SEQ ID NO: 1015 - protein, 11 aa, synthetic construct
  REGION 1..11: note = Synthetic
LERLFAEMPDY

SEQ ID NO: 1016 - protein, 11 aa, synthetic construct
  REGION 1..11: note = Synthetic
LERLFAEMPDY

SEQ ID NO: 1017 - protein, 17 aa, synthetic construct
  REGION 1..17: note = Synthetic
EQLIEKIKNLWTRVRGY

SEQ ID NO: 1018 - protein, 34 aa, synthetic construct
  REGION 1..34: note = Synthetic
FGTILKALAKIAAKAVKKLATKPGATYMLKQNLE

SEQ ID NO: 1019 - protein, 25 aa, synthetic construct
  REGION 1..25: note = Synthetic
FFTELGASIASIFTNWFKSSTEPSH

SEQ ID NO: 1020 - protein, 23 aa, synthetic construct
  REGION 1..23: note = Synthetic
SLISSIADDIDHAWNKLLGRHRK

SEQ ID NO: 1021 - protein, 12 aa, synthetic construct
  REGION 1..12: note = Synthetic
YQKVWSKITKWG

SEQ ID NO: 1022 - protein, 11 aa, synthetic construct
  REGION 1..11: note = Synthetic
LEKLFANMPDY

SEQ ID NO: 1023 - protein, 19 aa, synthetic construct
  REGION 1..19: note = Synthetic
EFLNSFSKLMQKVIKIHQS

SEQ ID NO: 1024 - protein, 40 aa, synthetic construct
  REGION 1..40: note = Synthetic
YREGGECLQRCIGLFHKIGTCNFRFKCCKFQIPEKKTKIL

SEQ ID NO: 1025 - protein, 16 aa, synthetic construct
  REGION 1..16: note = Synthetic
MGKFARKFCQFMCGIC

SEQ ID NO: 1026 - protein, 16 aa, synthetic construct
  REGION 1..16: note = Synthetic
MGKFARKFCQFMCGIC

SEQ ID NO: 1027 - protein, 13 aa, synthetic construct
  REGION 1..13: note = Synthetic
SADKFWRRFARRR

SEQ ID NO: 1028 - protein, 11 aa, synthetic construct
  REGION 1..11: note = Synthetic
CSDLCQDVDDA

SEQ ID NO: 1029 - protein, 41 aa, synthetic construct
  REGION 1..41: note = Synthetic
IKDAVKKIADEVPDDVKKNAKDIAVKIAKSVTKSIFKYFLN

SEQ ID NO: 1030 - protein, 12 aa, synthetic construct
  REGION 1..12: note = Synthetic
IMGLIKKVAGAL

SEQ ID NO: 1031 - protein, 35 aa, synthetic construct
  REGION 1..35: note = Synthetic
IGASVRKICEKCRLIRRRGRIIVICSNPRHKQRQG

SEQ ID NO: 1032 - protein, 16 aa, synthetic construct
  REGION 1..16: note = Synthetic
KIKTCWNKILRGAKEY

SEQ ID NO: 1033 - protein, 20 aa, synthetic construct
  REGION 1..20: note = Synthetic
EVAQFVKDLLKHLRMIFRHG

SEQ ID NO: 1034 - protein, 30 aa, synthetic construct
  REGION 1..30: note = Synthetic
RALLDKLKSLGKVVGKVALGVAQHYLNPQQ

SEQ ID NO: 1035 - protein, 30 aa, synthetic construct
  REGION 1..30: note = Synthetic
RALLDKLKSLGKVVGKVAIGVAQHYLNPQQ

SEQ ID NO: 1036 - protein, 29 aa, synthetic construct
  REGION 1..29: note = Synthetic
RALLDKLKSLGKVVGKVAIGVAQHYLNPQ

SEQ ID NO: 1037 - protein, 17 aa, synthetic construct
  REGION 1..17: note = Synthetic
FINKLMTFIRKALKPTR

SEQ ID NO: 1038 - protein, 12 aa, synthetic construct
  REGION 1..12: note = Synthetic
VMGIIKKIAGAL

SEQ ID NO: 1039 - protein, 17 aa, synthetic construct
  REGION 1..17: note = Synthetic
DFLERLKKIMKEKYSKC

SEQ ID NO: 1040 - protein, 15 aa, synthetic construct
  REGION 1..15: note = Synthetic
EMKNAMKKLWTRVRK

SEQ ID NO: 1041 - protein, 15 aa, synthetic construct
  REGION 1..15: note = Synthetic
CEKAVHDLWHIIKKF

SEQ ID NO: 1042 - protein, 37 aa, synthetic construct
  REGION 1..37: note = Synthetic
GNFFKDLEKMGQRVRDAVISAAPAVDTLAKAKALGQG

SEQ ID NO: 1043 - protein, 24 aa, synthetic construct
  REGION 1..24: note = Synthetic
LVSSIGRALGGLLADVVKSKGQPA

SEQ ID NO: 1044 - protein, 23 aa, synthetic construct
  REGION 1..23: note = Synthetic
LVSSIGRALGGLLADVVKSKQPA

SEQ ID NO: 1045 - protein, 24 aa, synthetic construct
  REGION 1..24: note = Synthetic
LVSSIGRALGGLLADVVKSKGQPA

SEQ ID NO: 1046 - protein, 23 aa, synthetic construct
  REGION 1..23: note = Synthetic
FLKRLLQKIKTCWNKILMGTKEH

SEQ ID NO: 1047 - protein, 17 aa, synthetic construct
  REGION 1..17: note = Synthetic
LFDIIKTAISIIVKAVE

SEQ ID NO: 1048 - protein, 27 aa, synthetic construct
  REGION 1..27: note = Synthetic
DFIKACGRELVRVWVEICGSVSWGRTA

SEQ ID NO: 1049 - protein, 36 aa, synthetic construct
  REGION 1..36: note = Synthetic
NIFKEIERAVARTRDAVISAGPAVRTVAAATSVASG

SEQ ID NO: 1050 - protein, 19 aa, synthetic construct
  REGION 1..19: note = Synthetic
GLVDVLGKVGGLIKKLLPG

SEQ ID NO: 1051 - protein, 23 aa, synthetic construct
  REGION 1..23: note = Synthetic
FLDKLKKGASDFANALVNSIKGT

SEQ ID NO: 1052 - protein, 30 aa, synthetic construct
  REGION 1..30: note = Synthetic
RALWKNMLKGIGKLAGQAALGAVKTLVGAE

SEQ ID NO: 1053 - protein, 21 aa, synthetic construct
  REGION 1..21: note = Synthetic
LIRGAIHAGKAIHGLIHRRRH

SEQ ID NO: 1054 - protein, 34 aa, synthetic construct
  REGION 1..34: note = Synthetic
SIAKLMEEFMEKVFNFGKSEALKMGSAPTPAPKN

SEQ ID NO: 1055 - protein, 15 aa, synthetic construct
  REGION 1..15: note = Synthetic
LWDKFQKFLKKVIRI

SEQ ID NO: 1056 - protein, 23 aa, synthetic construct
  REGION 1..23: note = Synthetic
EVTRLAKDLLQQLRKGVRQGKFE

SEQ ID NO: 1057 - protein, 32 aa, synthetic construct
  REGION 1..32: note = Synthetic
LKSFMERIINEIDRFGIKIKRNFSRLLYSSKN

SEQ ID NO: 1058 - protein, 21 aa, synthetic construct
  REGION 1..21: note = Synthetic
STLRDFLERLKKIMKEKYSKC

SEQ ID NO: 1059 - protein, 21 aa, synthetic construct
  REGION 1..21: note = Synthetic
STLRDFLERLKKIMKEKYSKC

SEQ ID NO: 1060 - protein, 21 aa, synthetic construct
  REGION 1..21: note = Synthetic
STLRDFLERLKKIMKEKYSKC

SEQ ID NO: 1061 - protein, 28 aa, synthetic construct
  REGION 1..28: note = Synthetic
FLKGVGKALAGVGKMVADQFGNLLQAGQ

SEQ ID NO: 1062 - protein, 28 aa, synthetic construct
  REGION 1..28: note = Synthetic
FLKGVGKALAGVGKVVADQFGNLLQAGQ

SEQ ID NO: 1063 - protein, 23 aa, synthetic construct
  REGION 1..23: note = Synthetic
EVAQFVQTLLRYLQSLYRHGNFN

SEQ ID NO: 1064 - protein, 30 aa, synthetic construct
  REGION 1..30: note = Synthetic
ALWKNMLKGIGKLAGQAALGAVKTLVGAES

SEQ ID NO: 1065 - protein, 41 aa, synthetic construct
  REGION 1..41: note = Synthetic
GACKKIMRTCLRLISRDILAGKKPQEVCVDIKLCKHKAGLI

SEQ ID NO: 1066 - protein, 24 aa, synthetic construct
  REGION 1..24: note = Synthetic
FWGALIKGAAKLIPSVVGLFKKKQ

SEQ ID NO: 1067 - protein, 13 aa, synthetic construct
  REGION 1..13: note = Synthetic
IIGAIPQVIGAIR

SEQ ID NO: 1068 - protein, 13 aa, synthetic construct
  REGION 1..13: note = Synthetic
IIGAIPQVIGAIR

SEQ ID NO: 1069 - protein, 23 aa, synthetic construct
  REGION 1..23: note = Synthetic
FLKRLLQKIKTCWNKILMGTKEH

SEQ ID NO: 1070 - protein, 19 aa, synthetic construct
  REGION 1..19: note = Synthetic
GFFDLAKKVVGGIRNALGI

SEQ ID NO: 1071 - protein, 21 aa, synthetic construct
  REGION 1..21: note = Synthetic
LKDFLENLKRIMQKRYSKCRR

SEQ ID NO: 1072 - protein, 11 aa, synthetic construct
  REGION 1..11: note = Synthetic
AHQVLANLLKM

SEQ ID NO: 1073 - protein, 36 aa, synthetic construct
  REGION 1..36: note = Synthetic
RYLATFLQPLSQKWIAFLLKKIFSKRSSIRKTLPFS

SEQ ID NO: 1074 - protein, 15 aa, synthetic construct
  REGION 1..15: note = Synthetic
LFDVIKKVASVIGGL

SEQ ID NO: 1075 - protein, 39 aa, synthetic construct
  REGION 1..39: note = Synthetic
RDLKKILNDWDENCEGCLEKSDFIKRIEELKPKYTRSEL

SEQ ID NO: 1076 - protein, 19 aa, synthetic construct
  REGION 1..19: note = Synthetic
GIVDFAKKVVGGIRNALGI

SEQ ID NO: 1077 - protein, 26 aa, synthetic construct
  REGION 1..26: note = Synthetic
IFYRLDRICEDCYSLFREPQILSFCK

SEQ ID NO: 1078 - protein, 35 aa, synthetic construct
  REGION 1..35: note = Synthetic
DLLRRLKKLLDEVDTEHETNDFLEDFFDLIFFKKI

SEQ ID NO: 1079 - protein, 23 aa, synthetic construct
  REGION 1..23: note = Synthetic
FLKRLLQEIKTCWNKILMGTKEH

SEQ ID NO: 1080 - protein, 23 aa, synthetic construct
  REGION 1..23: note = Synthetic
FLKRLLQEIKTCWNKILMGTKEH

SEQ ID NO: 1081 - protein, 23 aa, synthetic construct
  REGION 1..23: note = Synthetic
FLKRLLQEIKTCWNKILMGTKEH

SEQ ID NO: 1082 - protein, 23 aa, synthetic construct
  REGION 1..23: note = Synthetic
FLKRLLQEIKTCWNKILMGTKEH

SEQ ID NO: 1083 - protein, 23 aa, synthetic construct
  REGION 1..23: note = Synthetic
FLKRLLQEIKTCWNKILMGTKEH

SEQ ID NO: 1084 - protein, 23 aa, synthetic construct
  REGION 1..23: note = Synthetic
FLKRLLQEIKTCWNKILMGTKEH

SEQ ID NO: 1085 - protein, 19 aa, synthetic construct
  REGION 1..19: note = Synthetic
GFVDLAKKVVGGIRNALGI

SEQ ID NO: 1086 - protein, 17 aa, synthetic construct
  REGION 1..17: note = Synthetic
LSDIIKTAISIIVKAVE

SEQ ID NO: 1087 - protein, 21 aa, synthetic construct
  REGION 1..21: note = Synthetic
LIKGAIHAGKAIHGLIHRRRH

SEQ ID NO: 1088 - protein, 25 aa, synthetic construct
  REGION 1..25: note = Synthetic
SILRGLKKLGKMGQAFVNCEIYKKC

SEQ ID NO: 1089 - protein, 15 aa, synthetic construct
  REGION 1..15: note = Synthetic
LFDIVKKVVGAIGSL

SEQ ID NO: 1090 - protein, 24 aa, synthetic construct
  REGION 1..24: note = Synthetic
SLFQMINEFFTSIGTTIKDLFTFR

SEQ ID NO: 1091 - protein, 15 aa, synthetic construct
  REGION 1..15: note = Synthetic
LLDIVKKVVGAFGSL

SEQ ID NO: 1092 - protein, 15 aa, synthetic construct
  REGION 1..15: note = Synthetic
LLDIVKKVVGAFGSL

SEQ ID NO: 1093 - protein, 15 aa, synthetic construct
  REGION 1..15: note = Synthetic
LFDIVKKVVGAFGSL

SEQ ID NO: 1094 - protein, 15 aa, synthetic construct
  REGION 1..15: note = Synthetic
LFDIVKKVVGAFGSL

SEQ ID NO: 1095 - protein, 27 aa, synthetic construct
  REGION 1..27: note = Synthetic
GMWGSLLKGVATVVKHVLPHALSSQQS

SEQ ID NO: 1096 - protein, 26 aa, synthetic construct
  REGION 1..26: note = Synthetic
NMARKCRECCGGIGKCFGPQCLCNRI

SEQ ID NO: 1097 - protein, 39 aa, synthetic construct
  REGION 1..39: note = Synthetic
IFGSLFSLGSKLLPTVFKLFSRKKQRALMKRDLEDIMDP

SEQ ID NO: 1098 - protein, 12 aa, synthetic construct
  REGION 1..12: note = Synthetic
ILGLLGKALSHL

SEQ ID NO: 1099 - protein, 13 aa, synthetic construct
  REGION 1..13: note = Synthetic
LIGAIPQVIGAIR

SEQ ID NO: 1100 - protein, 19 aa, synthetic construct
  REGION 1..19: note = Synthetic
SLVKLVSTLLSLVPSLMKG

SEQ ID NO: 1101 - protein, 11 aa, synthetic construct
  REGION 1..11: note = Synthetic
AMRKYLDSILN

SEQ ID NO: 1102 - protein, 19 aa, synthetic construct
  REGION 1..19: note = Synthetic
GILDVAKTLVGKLRNVLGI

SEQ ID NO: 1103 - protein, 30 aa, synthetic construct
  REGION 1..30: note = Synthetic
DCYRRFEKGVEKGQKCWCIPTGLKYSKKKE

SEQ ID NO: 1104 - protein, 20 aa, synthetic construct
  REGION 1..20: note = Synthetic
KEFLERLKSLIQRMIHQHLS

SEQ ID NO: 1105 - protein, 38 aa, synthetic construct
  REGION 1..38: note = Synthetic
LKEFGNNLKDAFESIPEATRKLMTSFAEGLKNLRLPLL

SEQ ID NO: 1106 - protein, 17 aa, synthetic construct
  REGION 1..17: note = Synthetic
FLNRWITFCQSIISTLT

SEQ ID NO: 1107 - protein, 13 aa, synthetic construct
  REGION 1..13: note = Synthetic
CVRFVKKVVEKVG

SEQ ID NO: 1108 - protein, 36 aa, synthetic construct
  REGION 1..36: note = Synthetic
KAINELIKVMNDLLPKSNLRKRKRSQNLFRGRRAST

SEQ ID NO: 1109 - protein, 26 aa, synthetic construct
  REGION 1..26: note = Synthetic
IGAVLKVLTTGLPALISWIKRKRQQG

SEQ ID NO: 1110 - protein, 26 aa, synthetic construct
  REGION 1..26: note = Synthetic
IGAVLKVLTTGLPALISWIKRKRQQG

SEQ ID NO: 1111 - protein, 26 aa, synthetic construct
  REGION 1..26: note = Synthetic
IGAVLKVLTTGLPALISWIKRKRQQG

SEQ ID NO: 1112 - protein, 26 aa, synthetic construct
  REGION 1..26: note = Synthetic
IGAVLKVLTTGLPALISWIKRKRQQG

SEQ ID NO: 1113 - protein, 26 aa, synthetic construct
  REGION 1..26: note = Synthetic
IGAVLKVLTTGLPALISWIKRKRQQG

SEQ ID NO: 1114 - protein, 14 aa, synthetic construct
  REGION 1..14: note = Synthetic
WVQKYIEYLDQMSK

SEQ ID NO: 1115 - protein, 25 aa, synthetic construct
  REGION 1..25: note = Synthetic
ERCCKNGKRGCGRWCRDHSRCCGRR

SEQ ID NO: 1116 - protein, 12 aa, synthetic construct
  REGION 1..12: note = Synthetic
IIKKVASVVGGL

SEQ ID NO: 1117 - protein, 26 aa, synthetic construct
  REGION 1..26: note = Synthetic
IGAVLKVLATGLPALISWIKRKRQQG

SEQ ID NO: 1118 - protein, 36 aa, synthetic construct
  REGION 1..36: note = Synthetic
ILDSFKQFAKGVGKDLIKGAAQGVLSTMSCKLAKTC

SEQ ID NO: 1119 - protein, 18 aa, synthetic construct
  REGION 1..18: note = Synthetic
FIKKLMTFIRKVLKTPRL

SEQ ID NO: 1120 - protein, 19 aa, synthetic construct
  REGION 1..19: note = Synthetic
REFVKQLESLLQKVTGYYE

SEQ ID NO: 1121 - protein, 24 aa, synthetic construct
  REGION 1..24: note = Synthetic
RLTKLAEQLMEKIKNLCYTKVLGY

SEQ ID NO: 1122 - protein, 15 aa, synthetic construct
  REGION 1..15: note = Synthetic
LFDIVKKVVGALGSL

SEQ ID NO: 1123 - protein, 21 aa, synthetic construct
  REGION 1..21: note = Synthetic
QVLHQVQKLANELLRKLWSSG

SEQ ID NO: 1124 - protein, 11 aa, synthetic construct
  REGION 1..11: note = Synthetic
AVKKYINSLLA

SEQ ID NO: 1125 - protein, 24 aa, synthetic construct
  REGION 1..24: note = Synthetic
LVSSIGKALGGLLADVVKSKGQPA

SEQ ID NO: 1126 - protein, 24 aa, synthetic construct
  REGION 1..24: note = Synthetic
LVSSIGKALGGLLADVVKSKGQPA

SEQ ID NO: 1127 - protein, 30 aa, synthetic construct
  REGION 1..30: note = Synthetic
RWIAFCHNILSCCKNMTRFQPPQAKDPWVH

SEQ ID NO: 1128 - protein, 30 aa, synthetic construct
  REGION 1..30: note = Synthetic
RWIAFCHNILSCCKNMTRFQPLQAKDPWVH

SEQ ID NO: 1129 - protein, 20 aa, synthetic construct
  REGION 1..20: note = Synthetic
TQAWTNFKKWFKKWFKETFS

SEQ ID NO: 1130 - protein, 20 aa, synthetic construct
  REGION 1..20: note = Synthetic
TQAWTNFKKWFKKWFKETFS

SEQ ID NO: 1131 - protein, 39 aa, synthetic construct
  REGION 1..39: note = Synthetic
DCTACLSNLVNRIFSICNNAIGARVQLVDCFIQYEQRSF

SEQ ID NO: 1132 - protein, 23 aa, synthetic construct
  REGION 1..23: note = Synthetic
AVRRLLTAVQNIVDDVRNSKASC

SEQ ID NO: 1133 - protein, 25 aa, synthetic construct
  REGION 1..25: note = Synthetic
IGAILKVLATGLPTLISWIKNKRKQ

SEQ ID NO: 1134 - protein, 25 aa, synthetic construct
  REGION 1..25: note = Synthetic
SILRGLKKLGNMGQAFVNCKIYKKC

SEQ ID NO: 1135 - protein, 26 aa, synthetic construct
  REGION 1..26: note = Synthetic
IGAVLKVLTTGLPALIGWIKRKRQQG

SEQ ID NO: 1136 - protein, 15 aa, synthetic construct
  REGION 1..15: note = Synthetic
QELFSLLKRLINKVN

SEQ ID NO: 1137 - protein, 19 aa, synthetic construct
  REGION 1..19: note = Synthetic
GIVDFAKGVLGKIKNVLGI

SEQ ID NO: 1138 - protein, 34 aa, synthetic construct
  REGION 1..34: note = Synthetic
LSNLVNRIFSICNNAIGARVQLVDCFIQYEQRSF

SEQ ID NO: 1139 - protein, 34 aa, synthetic construct; identical to SEQ ID NO: 1138
  REGION 1..34: note = Synthetic

SEQ ID NO: 1140 - protein, 23 aa, synthetic construct
  REGION 1..23: note = Synthetic
RTLKDFLERLKTIMQEKYSKGGS

SEQ ID NO: 1141 - protein, 15 aa, synthetic construct
  REGION 1..15: note = Synthetic
LFDIVKKVVGTIAGL

SEQ ID NO: 1142 - protein, 26 aa, synthetic construct
  REGION 1..26: note = Synthetic
GLFGKLIKKFGRKAISYAVKKARGKH

SEQ ID NO: 1143 - protein, 26 aa, synthetic construct
  REGION 1..26: note = Synthetic
GLFGKLIKKFGRKAISYAVKKARGKN

SEQ ID NO: 1144 - protein, 15 aa, synthetic construct
  REGION 1..15: note = Synthetic
QAIRCMQSLFRTVKR

SEQ ID NO: 1145 - protein, 20 aa, synthetic construct
  REGION 1..20: note = Synthetic
IGKCWHDIMECWQHCHGRKV

SEQ ID NO: 1146 - protein, 20 aa, synthetic construct
  REGION 1..20: note = Synthetic
KKWVQDAKKYLDQISQTTKP

SEQ ID NO: 1147 - protein, 34 aa, synthetic construct; identical to SEQ ID NO: 1138
  REGION 1..34: note = Synthetic

SEQ ID NO: 1148 - protein, 28 aa, synthetic construct
  REGION 1..28: note = Synthetic
KYWTECCGRIGPHCSRCICPGVVCPKRG

SEQ ID NO: 1149 - protein, 13 aa, synthetic construct
  REGION 1..13: note = Synthetic
FFRVLAKLGKLAK

SEQ ID NO: 1150 - protein, 20 aa, synthetic construct
  REGION 1..20: note = Synthetic
KEFLERLKSLIQKMIHQHLS

SEQ ID NO: 1151 - protein, 26 aa, synthetic construct
  REGION 1..26: note = Synthetic
GLWKNMLSGIGKLAGQAALGAVKTLV

SEQ ID NO: 1152 - protein, 14 aa, synthetic construct
  REGION 1..14: note = Synthetic
CCNFLGKCCHLVKG

SEQ ID NO: 1153 - protein, 31 aa, synthetic construct
  REGION 1..31: note = Synthetic
ALWKTLLKKVGKVAGKAVLNAVTNMANQNEQ

SEQ ID NO: 1154 - protein, 15 aa, synthetic construct
  REGION 1..15: note = Synthetic
EDIASDLKSMLQDLE

SEQ ID NO: 1155 - protein, 15 aa, synthetic construct
  REGION 1..15: note = Synthetic
VQSCADSCSKMCTKI

SEQ ID NO: 1156 - protein, 12 aa, synthetic construct
  REGION 1..12: note = Synthetic
VKTVCKKVLKQG

SEQ ID NO: 1157 - protein, 15 aa, synthetic construct
  REGION 1..15: note = Synthetic
DKAKKFGGKIKKWFG

SEQ ID NO: 1158 - protein, 23 aa, synthetic construct
  REGION 1..23: note = Synthetic
EKLKKIGQKIQGFVPKLAPRTDY

SEQ ID NO: 1159 - protein, 29 aa, synthetic construct
  REGION 1..29: note = Synthetic
KLCRNVGGKLKKVLHFIQKSVSKIKSCKK

SEQ ID NO: 1160 - protein, 25 aa, synthetic construct
  REGION 1..25: note = Synthetic
IGAILKVLSTGLPALISWIKRKRQE

SEQ ID NO: 1161 - protein, 29 aa, synthetic construct
  REGION 1..29: note = Synthetic
RGIMDTVKNVAKNLAGQLLDKLKCKITAC

SEQ ID NO: 1162 - protein, 42 aa, synthetic construct
  REGION 1..42: note = Synthetic
KKILDDWGEMCKGCAEKSDYIRKINELMPKYAPKAASARTDL

SEQ ID NO: 1163 - protein, 30 aa, synthetic construct
  REGION 1..30: note = Synthetic
TWISFCHNILSCCKSMTKFLPPQAKEPWSK

SEQ ID NO: 1164 - protein, 21 aa, synthetic construct
  REGION 1..21: note = Synthetic
NLIRAAERIFKDCMHLWNCGK

SEQ ID NO: 1165 - protein, 15 aa, synthetic construct
  REGION 1..15: note = Synthetic
VYEIIKTWDHWAESP

SEQ ID NO: 1166 - protein, 20 aa, synthetic construct
  REGION 1..20: note = Synthetic
KEFLERLKSLLQKMVHQHLP

SEQ ID NO: 1167 - protein, 22 aa, synthetic construct
  REGION 1..22: note = Synthetic
KQFLDYLQEFLAVINTEWTIEG

SEQ ID NO: 1168 - protein, 41 aa, synthetic construct
  REGION 1..41: note = Synthetic
KILDDWGETCKGCAEKSDYIRKINELMPKYAPKAASSRTDL

SEQ ID NO: 1169 - protein, 39 aa, synthetic construct
  REGION 1..39: note = Synthetic
DFLKELEGVGQRVRDSIISAGPAIDVLKKSQGPRRWSRP

SEQ ID NO: 1170 - protein, 33 aa, synthetic construct
  REGION 1..33: note = Synthetic
LLQRIQSWWKNLFQHGASSSTRRLRQLTNGEKK

SEQ ID NO: 1171 - protein, 29 aa, synthetic construct
  REGION 1..29: note = Synthetic
KEFLERFKSLLQKMIHQHLSSRTHGSEDS

SEQ ID NO: 1172 - protein, 29 aa, synthetic construct
  REGION 1..29: note = Synthetic
KEFLERFKSLLQKMIHQHLSSRTHGSEDS

SEQ ID NO: 1173 - protein, 29 aa, synthetic construct
  REGION 1..29: note = Synthetic
KEFLERFKSLLQKMIHQHLSSRTHGSEDS

SEQ ID NO: 1174 - protein, 29 aa, synthetic construct
  REGION 1..29: note = Synthetic
KEFLERFKSLLQKMIHQHLSSRTHGSEDS

SEQ ID NO: 1175 - protein, 29 aa, synthetic construct
  REGION 1..29: note = Synthetic
KEFLERFKSLLQKMIHQHLSSRTHGSEDS

SEQ ID NO: 1176 - protein, 29 aa, synthetic construct
  REGION 1..29: note = Synthetic
KEFLERFKSLLQKMIHQHLSSRTHGSEDS

SEQ ID NO: 1177 - protein, 12 aa, synthetic construct
  REGION 1..12: note = Synthetic
SGLGCWRRIVDS

SEQ ID NO: 1178 - protein, 20 aa, synthetic construct
  REGION 1..20: note = Synthetic
KEFLERLKSLIQKMIHQHLS

SEQ ID NO: 1179 - protein, 20 aa, synthetic construct
  REGION 1..20: note = Synthetic
KEFLERLKSLIQKMIHQHLS

SEQ ID NO: 1180 - protein, 12 aa, synthetic construct
  REGION 1..12: note = Synthetic
EEYQALVQTVGK

SEQ ID NO: 1181 - protein, 26 aa, synthetic construct
  REGION 1..26: note = Synthetic
RTLKDFLERLKTIMQEKYSKGGSWIF

SEQ ID NO: 1182 - protein, 13 aa, synthetic construct
  REGION 1..13: note = Synthetic
KLIKTVASAIANQ

SEQ ID NO: 1183 - protein, 20 aa, synthetic construct
  REGION 1..20: note = Synthetic
DRLKQFMQKLIDNLDQLKSC

SEQ ID NO: 1184 - protein, 11 aa, synthetic construct
  REGION 1..11: note = Synthetic
GLLKGISALLS

SEQ ID NO: 1185 - protein, 28 aa, synthetic construct
  REGION 1..28: note = Synthetic
IFDKLKNFAKGVAQSLLNKASCKLSGQC

SEQ ID NO: 1186 - protein, 20 aa, synthetic construct
  REGION 1..20: note = Synthetic
TQAWTNFKKWFKNWFKKTFS

SEQ ID NO: 1187 - protein, 16 aa, synthetic construct
  REGION 1..16: note = Synthetic
LGSLLKTGLKVGSNLL

SEQ ID NO: 1188 - protein, 29 aa, synthetic construct
  REGION 1..29: note = Synthetic
FRKLFRVYSNFLRGKLKLYTGEACRTGDR

SEQ ID NO: 1189 - protein, 25 aa, synthetic construct
  REGION 1..25: note = Synthetic
LIGSIGKALGGLLVDVLKPKLQAAS

SEQ ID NO: 1190 - protein, 30 aa, synthetic construct
  REGION 1..30: note = Synthetic
DCYRRFEKGVEKGQKCWCIPTGLRYSKEKE

SEQ ID NO: 1191 - protein, 30 aa, synthetic construct; identical to SEQ ID NO: 1190
  REGION 1..30: note = Synthetic

SEQ ID NO: 1192 - protein, 30 aa, synthetic construct; identical to SEQ ID NO: 1190
  REGION 1..30: note = Synthetic

SEQ ID NO: 1193 - protein, 30 aa, synthetic construct; identical to SEQ ID NO: 1190
  REGION 1..30: note = Synthetic

SEQ ID NO: 1194 - protein, 30 aa, synthetic construct; identical to SEQ ID NO: 1190
  REGION 1..30: note = Synthetic

SEQ ID NO: 1195 - protein, 30 aa, synthetic construct; identical to SEQ ID NO: 1190
  REGION 1..30: note = Synthetic

SEQ ID NO: 1196 - protein, 16 aa, synthetic construct
  REGION 1..16: note = Synthetic
LFDIVKKIAGHIASSI

SEQ ID NO: 1197 - protein, 16 aa, synthetic construct
  REGION 1..16: note = Synthetic
LFDIVKKIAGHIASSI

SEQ ID NO: 1198 - protein, 16 aa, synthetic construct
  REGION 1..16: note = Synthetic
DCMRTCGGAIGPWENL

SEQ ID NO: 1199 - protein, 23 aa, synthetic construct
  REGION 1..23: note = Synthetic
IKDWIKGAAKKLIKTVASHIANQ

SEQ ID NO: 1200 - protein, 24 aa, synthetic construct
  REGION 1..24: note = Synthetic
LLKELWTKIKGAGKAVLGKIKGLL

SEQ ID NO: 1201 - protein, 13 aa, synthetic construct
  REGION 1..13: note = Synthetic
MEKAADKIKNLFG

SEQ ID NO: 1202 - protein, 19 aa, synthetic construct
  REGION 1..19: note = Synthetic
LLEKIKTCWNKILSGTKEH

SEQ ID NO: 1203 - protein, 20 aa, synthetic construct
  REGION 1..20: note = Synthetic
ATKFIEKLMTFIRRASKNAR

SEQ ID NO: 1204 - protein, 29 aa, synthetic construct
  REGION 1..29: note = Synthetic
CRKVVKYWTHCCQEGLRCTWERGVPKCEP

SEQ ID NO: 1205 - protein, 26 aa, synthetic construct
  REGION 1..26: note = Synthetic
FWGHIWNAVKRVGANALHGAVTGALS

SEQ ID NO: 1206 - protein, 22 aa, synthetic construct
  REGION 1..22: note = Synthetic
ETIVEFLNKWITFCQSIISTLT

SEQ ID NO: 1207 - protein, 22 aa, synthetic construct
  REGION 1..22: note = Synthetic
ETIVEFLNKWITFCQSIISTLT

SEQ ID NO: 1208 - protein, 16 aa, synthetic construct
  REGION 1..16: note = Synthetic
LFDIVKKIAGHIAGSI

SEQ ID NO: 1209 - protein, 16 aa, synthetic construct
  REGION 1..16: note = Synthetic
LFDIVKKIAGHIAGSI

SEQ ID NO: 1210 - protein, 28 aa, synthetic construct
  REGION 1..28: note = Synthetic
FLDKLKNFAKGVAQSLLNKASCKLSGQC

SEQ ID NO: 1211 - protein, 24 aa, synthetic construct
  REGION 1..24: note = Synthetic
GFKDWIKGAAKKLIKTVAANIANQ

SEQ ID NO: 1212 - protein, 13 aa, synthetic construct
  REGION 1..13: note = Synthetic
RVVEKFLKRAENS

SEQ ID NO: 1213 - protein, 36 aa, synthetic construct
  REGION 1..36: note = Synthetic
FSSIFRGVAKFASKGLGKDLARLGVNLVACKISKQC

SEQ ID NO: 1214 - protein, 29 aa, synthetic construct
  REGION 1..29: note = Synthetic
NMFSDVADELRRLVIVFDCRSVSIQQLLR

SEQ ID NO: 1215 - protein, 32 aa, synthetic construct
  REGION 1..32: note = Synthetic
WYQLIRTFGNLIHQKYRKLLEAYRKLRDIFSG

SEQ ID NO: 1216 - protein, 27 aa, synthetic construct
  REGION 1..27: note = Synthetic
ENLTQFFSSLESLIQKSITRLSLNKKR

SEQ ID NO: 1217 - protein, 13 aa, synthetic construct
  REGION 1..13: note = Synthetic
KYATNCAKTCGKC

SEQ ID NO: 1218 - protein, 15 aa, synthetic construct
  REGION 1..15: note = Synthetic
VQSCVDSCSKMCTKI

SEQ ID NO: 1219 - protein, 15 aa, synthetic construct
  REGION 1..15: note = Synthetic
VQSCVDSCSKMCTKI

SEQ ID NO: 1220 - protein, 17 aa, synthetic construct
  REGION 1..17: note = Synthetic
FVDFLKKVAGTIANVVT

SEQ ID NO: 1221 - protein, 28 aa, synthetic construct
  REGION 1..28: note = Synthetic
ALWKDILKNVGKAAGKAVLNTVTDMVNQ

SEQ ID NO: 1222 - protein, 31 aa, synthetic construct
  REGION 1..31: note = Synthetic
ALWKDILKNVGKAAGKAVLNTVTDMVNQGEQ

SEQ ID NO: 1223 - protein, 13 aa, synthetic construct
  REGION 1..13: note = Synthetic
KYATNCAKTCGKC

SEQ ID NO: 1224 - protein, 16 aa, synthetic construct
  REGION 1..16: note = Synthetic
LFDIVKKIAGHIVSSI

SEQ ID NO: 1225 - protein, 32 aa, synthetic construct
  REGION 1..32: note = Synthetic
LGSFMKGVGKGLATVGKIVADQFGKLLEAGQG

SEQ ID NO: 1226 - protein, 32 aa, synthetic construct
  REGION 1..32: note = Synthetic
LGSFMKGVGKGLATVGKIVADQFGKLLEAGKG

SEQ ID NO: 1227 - protein, 41 aa, synthetic construct
  REGION 1..41: note = Synthetic
KILDDWGETCKGCAEKSDYIRKINELMPKYAPKAASARTDL

SEQ ID NO: 1228 - protein, 24 aa, synthetic construct
  REGION 1..24: note = Synthetic
VWSTVLGGLKKFAKGGLEAIVNPK

SEQ ID NO: 1229 - protein, 16 aa, synthetic construct
  REGION 1..16: note = Synthetic
VDEVFSEVVKIFDKEG

SEQ ID NO: 1230 - protein, 19 aa, synthetic construct
  REGION 1..19: note = Synthetic
SRCYRSLYKCVAVCNRLVH

SEQ ID NO: 1231 - protein, 29 aa, synthetic construct
  REGION 1..29: note = Synthetic
KEFLERFKSLLQKMIHRHLSSRTHGSEDS

SEQ ID NO: 1232 - protein, 13 aa, synthetic construct
  REGION 1..13: note = Synthetic
VGRVHRLLRKGNY

SEQ ID NO: 1233 - protein, 14 aa, synthetic construct
  REGION 1..14: note = Synthetic
LYSALYKCMSFLKK

SEQ ID NO: 1234 - protein, 11 aa, synthetic construct
  REGION 1..11: note = Synthetic
LENLFTHMPDY

SEQ ID NO: 1235 - protein, 21 aa, synthetic construct
  REGION 1..21: note = Synthetic
HSFYKCIDNLCKRFRRQKHLV

SEQ ID NO: 1236 - protein, 19 aa, synthetic construct
  REGION 1..19: note = Synthetic
NWFSEAFKKVKEHLKTAFS

SEQ ID NO: 1237 - protein, 23 aa, synthetic construct
  REGION 1..23: note = Synthetic
GFRDVLKGAAKAFVKTVAGHIAN

SEQ ID NO: 1238 - protein, 24 aa, synthetic construct
  REGION 1..24: note = Synthetic
GFRDVLKGAAKAFVKTVAGHIANI

SEQ ID NO: 1239 - protein, 31 aa, synthetic construct
  REGION 1..31: note = Synthetic
LRGFLKGVGTALAGVGKVVADQFDKLLQAGQ

SEQ ID NO: 1240 - protein, 17 aa, synthetic construct
  REGION 1..17: note = Synthetic
KWVKQVVHMLSQRVKRM

SEQ ID NO: 1241 - protein, 32 aa, synthetic construct
  REGION 1..32: note = Synthetic
EKAEKFFDRLNSLIQKVHLKSSICHLMSSLMF

SEQ ID NO: 1242 - protein, 15 aa, synthetic construct
  REGION 1..15: note = Synthetic
RVLKRLLAMLRQHAF

SEQ ID NO: 1243 - protein, 34 aa, synthetic construct
  REGION 1..34: note = Synthetic
RGIMDTLKNLAKTAGKGALQSLVKMASCKLSGQC

SEQ ID NO: 1244 - protein, 23 aa, synthetic construct
  REGION 1..23: note = Synthetic
KIMRKIMTNLSRLCPVHKRSKRY

SEQ ID NO: 1245 - protein, 13 aa, synthetic construct
  REGION 1..13: note = Synthetic
AKKFGGKIMKWFS

SEQ ID NO: 1246 - protein, 26 aa, synthetic construct
  REGION 1..26: note = Synthetic
ALWKNMLSGIGKLAGQAALGAVKTLV

SEQ ID NO: 1247 - protein, 30 aa, synthetic construct
  REGION 1..30: note = Synthetic
GWKDWLNKGKEWLKKKGPGIMKAALKAATQ

SEQ ID NO: 1248 - protein, 22 aa, synthetic construct
  REGION 1..22: note = Synthetic
INTLKKVIQGLHEVIKLVSNHE

SEQ ID NO: 1249 - protein, 14 aa, synthetic construct
  REGION 1..14: note = Synthetic
KGIIRTIKDWYKGK

SEQ ID NO: 1250 - protein, 40 aa, synthetic construct
  REGION 1..40: note = Synthetic
EKGMKALKNYANDVINGPAEAPAAAAAPEEPPVEQRRRRR

SEQ ID NO: 1251 - protein, 32 aa, synthetic construct
  REGION 1..32: note = Synthetic
GILDSFKGVAKGVAKDLAGKLLDKLKCKITGC

SEQ ID NO: 1252 - protein, 11 aa, synthetic construct
  REGION 1..11: note = Synthetic
AHQVLATLFRI

SEQ ID NO: 1253 - protein, 29 aa, synthetic construct
  REGION 1..29: note = Synthetic
GLWKSLLKNVGKAAGKAALNAVTDMVNQA

SEQ ID NO: 1254 - protein, 29 aa, synthetic construct
  REGION 1..29: note = Synthetic
GLWKSLLKNVGKAAGKAALNAVTDMVNQS

SEQ ID NO: 1255 - protein, 29 aa, synthetic construct
  REGION 1..29: note = Synthetic
RGLMDTVKNVAKNLAGHMLDKLKCKITGC

SEQ ID NO: 1256 - protein, 15 aa, synthetic construct
  REGION 1..15: note = Synthetic
LFDIAKKVIGVIGSL

SEQ ID NO: 1257 - protein, 29 aa, synthetic construct
  REGION 1..29: note = Synthetic
GMFTNMLKGIGKLAGQAALGAVKTLAGEQ

SEQ ID NO: 1258 - protein, 22 aa, synthetic construct
  REGION 1..22: note = Synthetic
DAIEYFWQRFDTFLNNINENNP

SEQ ID NO: 1259 - protein, 42 aa, synthetic construct
  REGION 1..42: note = Synthetic
CAGLYKKCGKGVNTCCENRPCKCDLAMGNCICKKKFVEFFGG

SEQ ID NO: 1260 - protein, 41 aa, synthetic construct
  REGION 1..41: note = Synthetic
EKGMKALKNYANDVLNGPAEAPAPAAAAPEEPPVEQRRRRR

SEQ ID NO: 1261 - protein, 12 aa, synthetic construct
  REGION 1..12: note = Synthetic
WKAIIEAAKQAL

SEQ ID NO: 1262 - protein, 15 aa, synthetic construct
  REGION 1..15: note = Synthetic
LLEKLAKKFKGCKNK

SEQ ID NO: 1263 - protein, 15 aa, synthetic construct
  REGION 1..15: note = Synthetic
YSRGCSRITRCRRDA

SEQ ID NO: 1264 - protein, 22 aa, synthetic construct
  REGION 1..22: note = Synthetic
CKKVARVLYHLFYGIVKSVCVG

SEQ ID NO: 1265 - protein, 35 aa, synthetic construct
  REGION 1..35: note = Synthetic
VAASVRKICEKCRLIRRRGRLLVICSNPKHKQRQG

SEQ ID NO: 1266 - protein, 20 aa, synthetic construct
  REGION 1..20: note = Synthetic
LERISSFASSFINDLQDRVL

SEQ ID NO: 1267 - protein, 42 aa, synthetic construct; identical to SEQ ID NO: 1162
  REGION 1..42: note = Synthetic

SEQ ID NO: 1268 - protein, 26 aa, synthetic construct
  REGION 1..26: note = Synthetic
TTLKDFLKSLKRIMQKKYWQCESSLF

SEQ ID NO: 1269 - protein, 22 aa, synthetic construct
  REGION 1..22: note = Synthetic
RKLYNIIRRWPEWLENVDSYKK

SEQ ID NO: 1270 - protein, 36 aa, synthetic construct
  REGION 1..36: note = Synthetic
ILSLFTGGIKALGKTLFKMAGKAGAEHLACKATNQC

SEQ ID NO: 1271 - protein, 14 aa, synthetic construct
  REGION 1..14: note = Synthetic
IAKAVLSVVGQLVG

SEQ ID NO: 1272 - protein, 21 aa, synthetic construct
  REGION 1..21: note = Synthetic
KCFQHLDDCCSRKCNRFNKCV

SEQ ID NO: 1273 - protein, 14 aa, synthetic construct
  REGION 1..14: note = Synthetic
LEKLAKKFKGCKNK

SEQ ID NO: 1274 - protein, 29 aa, synthetic construct
  REGION 1..29: note = Synthetic
KEFLERFKSLLQKMIHQHLSSRTHGSEDS

SEQ ID NO: 1275 - protein, 29 aa, synthetic construct
  REGION 1..29: note = Synthetic
KEFLERFKSLLQKMIHQHLSSRTHGSEDS

SEQ ID NO: 1276 - protein, 29 aa, synthetic construct
  REGION 1..29: note = Synthetic
KEFLERFKSLLQKMIHQHLSSRTHGSEDS

SEQ ID NO: 1277 - protein, 13 aa, synthetic construct
  REGION 1..13: note = Synthetic
MKHLDQIFQNLKP

SEQ ID NO: 1278 - protein, 13 aa, synthetic construct
  REGION 1..13: note = Synthetic
LLKIAAKVGSNLL

SEQ ID NO: 1279 - protein, 26 aa, synthetic construct
  REGION 1..26: note = Synthetic
GLWKNMLSGIGKLAGEAALGAVKTLV

SEQ ID NO: 1280 - protein, 19 aa, synthetic construct
  REGION 1..19: note = Synthetic
QKCVQQLESLLQKAISRLA

SEQ ID NO: 1281 - protein, 20 aa, synthetic construct
  REGION 1..20: note = Synthetic
REFLERMKSLLQKMIHQHLS

SEQ ID NO: 1282 - protein, 15 aa, synthetic construct
  REGION 1..15: note = Synthetic
QELFSLLKRLINKVN

SEQ ID NO: 1283 - protein, 17 aa, synthetic construct
  REGION 1..17: note = Synthetic
KKWVQKYISLLKTPKQL

SEQ ID NO: 1284 - protein, 13 aa, synthetic construct
  REGION 1..13: note = Synthetic
IVSGAVSLVKKLG

SEQ ID NO: 1285 - protein, 20 aa, synthetic construct
  REGION 1..20: note = Synthetic
KVFNNCHHFVYSLYNKIKQK

SEQ ID NO: 1286 - protein, 19 aa, synthetic construct
  REGION 1..19: note = Synthetic
REFLNNWITFCQSIFSTLP

SEQ ID NO: 1287 - protein, 19 aa, synthetic construct
  REGION 1..19: note = Synthetic
LLEKIKTCWNKILSGTKEH

SEQ ID NO: 1288 - protein, 35 aa, synthetic construct
  REGION 1..35: note = Synthetic
IAQLVKKWIKTVLEARSKFQASLNEYCRALTNNSA

SEQ ID NO: 1289 - protein, 25 aa, synthetic construct
  REGION 1..25: note = Synthetic
RFLGALFKVASKVLPSVFCAITKKC

SEQ ID NO: 1290 - protein, 15 aa, synthetic construct
  REGION 1..15: note = Synthetic
VKKIIEKMLKNGKSN

SEQ ID NO: 1291 - protein, 19 aa, synthetic construct
  REGION 1..19: note = Synthetic
LLQKIKTCWNKILRGAKEY

SEQ ID NO: 1292 - protein, 14 aa, synthetic construct
  REGION 1..14: note = Synthetic
AKKCCHKVHNCCSK

SEQ ID NO: 1293 - protein, 22 aa, synthetic construct
  REGION 1..22: note = Synthetic
RKLYNLIRRWPEWLENVDSYKQ

SEQ ID NO: 1294 - protein, 14 aa, synthetic construct
  REGION 1..14: note = Synthetic
SAGKAIHDLIRRRH

SEQ ID NO: 1295 - protein, 12 aa, synthetic construct
  REGION 1..12: note = Synthetic
EVLSKLKSLLQK

SEQ ID NO: 1296 - protein, 19 aa, synthetic construct
  REGION 1..19: note = Synthetic
KWVQDFMKHLDKKTQTPKL

SEQ ID NO: 1297 - protein, 13 aa, synthetic construct
  REGION 1..13: note = Synthetic
KTYTELFKEYFEK

SEQ ID NO: 1298 - protein, 13 aa, synthetic construct
  REGION 1..13: note = Synthetic
KTYTELFKEYFEK

SEQ ID NO: 1299 - protein, 42 aa, synthetic construct
  REGION 1..42: note = Synthetic
AVNELVGVMHRLSSNIRRKKKGSRCCFGGGDRLNQNYPARSI

SEQ ID NO: 1300 - protein, 23 aa, synthetic construct
  REGION 1..23: note = Synthetic
FKDWIKGAAKKLIKTVASSIANE

SEQ ID NO: 1301 - protein, 21 aa, synthetic construct
  REGION 1..21: note = Synthetic
STLKDLLERLKTIMKEKYSKC

SEQ ID NO: 1302 - protein, 25 aa, synthetic construct
  REGION 1..25: note = Synthetic
FFGSLLSLGSKLLPSVFKLFQRKKE

SEQ ID NO: 1303 - protein, 21 aa, synthetic construct
  REGION 1..21: note = Synthetic
LKDFLENLKRIMQKRYSKCRR

SEQ ID NO: 1304 - protein, 39 aa, synthetic construct
  REGION 1..39: note = Synthetic
QLQQVISRIYQTATHLPKVCNIPQVSVCPFQKTMPGPSY

SEQ ID NO: 1305 - protein, 20 aa, synthetic construct
  REGION 1..20: note = Synthetic
KEFLRSFEKLIQQVIRDDSS

SEQ ID NO: 1306 - protein, 19 aa, synthetic construct
  REGION 1..19: note = Synthetic
LLQKIKTCWNKILRGAKEY

SEQ ID NO: 1307 - protein, 19 aa, synthetic construct
  REGION 1..19: note = Synthetic
EKAADKAKKFGGKIKKWFG

SEQ ID NO: 1308 - protein, 21 aa, synthetic construct
  REGION 1..21: note = Synthetic
NKVFNNCHHFVYSLYNKIKQK

SEQ ID NO: 1309 - protein, 21 aa, synthetic construct
  REGION 1..21: note = Synthetic
NKVFNNCHHFVYSLYNKIKQK

SEQ ID NO: 1310 - protein, 17 aa, synthetic construct
  REGION 1..17: note = Synthetic
KIKRIVQKILESAERTA

SEQ ID NO: 1311 - protein, 13 aa, synthetic construct
  REGION 1..13: note = Synthetic
CKKFISELFGFGK

SEQ ID NO: 1312 - protein, 27 aa, synthetic construct
  REGION 1..27: note = Synthetic
YTTLKDFLESLRRIMQKKYWQCGSSTF

SEQ ID NO: 1313 - protein, 26 aa, synthetic construct
  REGION 1..26: note = Synthetic
TTLKDFLESLRRIMQKKYWQCGSSTF

SEQ ID NO: 1314 - protein, 20 aa, synthetic construct
  REGION 1..20: note = Synthetic
ARSCCSRLGRCCREAKGYSG

SEQ ID NO: 1315 - protein, 23 aa, synthetic construct
  REGION 1..23: note = Synthetic
EFFSRLDSFIQKAISKLRSSAAN

SEQ ID NO: 1316 - protein, 13 aa, synthetic construct
  REGION 1..13: note = Synthetic
LVSGAVSLVKKLG

SEQ ID NO: 1317 - protein, 42 aa, synthetic construct
  REGION 1..42: note = Synthetic
WASKIGQTLGKIAKVGLKELIQPKREAMLRSAEAQGKRPWIL

SEQ ID NO: 1318 - protein, 24 aa, synthetic construct
  REGION 1..24: note = Synthetic
LMSSIGKALGGLIVDVLKPKTPAS

SEQ ID NO: 1319 - protein, 24 aa, synthetic construct
  REGION 1..24: note = Synthetic
LMSSIGKALGGLIVDVLKPKTPAS

SEQ ID NO: 1320 - protein, 36 aa, synthetic construct
  REGION 1..36: note = Synthetic
KVYSSVRKICKSCGLIRRHGKLFVRCINSKHNQRQN

SEQ ID NO: 1321 - protein, 20 aa, synthetic construct
  REGION 1..20: note = Synthetic
KEYLERLKSLIQKMIHQHLS

SEQ ID NO: 1322 - protein, 23 aa, synthetic construct
  REGION 1..23: note = Synthetic
WGALAKGALKLIPSLFSSFSKKD

SEQ ID NO: 1323 - protein, 28 aa, synthetic construct
  REGION 1..28: note = Synthetic
QILNRCDKIWNYCSSLGSAPYVSKFDSV

SEQ ID NO: 1324 - protein, 14 aa, synthetic construct
  REGION 1..14: note = Synthetic
LEKLAKKFRGCKNK

SEQ ID NO: 1325 - protein, 33 aa, synthetic construct
  REGION 1..33: note = Synthetic
AVDTLCKLFRNYSNFLRGKLTLYTGEACRRRDR

SEQ ID NO: 1326 - protein, 29 aa, synthetic construct
  REGION 1..29: note = Synthetic
KVLSEAVEQCTKACSSVCTGGSTAAVKSA

SEQ ID NO: 1327 - protein, 29 aa, synthetic construct
  REGION 1..29: note = Synthetic
KVLSEAVEQCTKACSSVCTGGSTAAVKSA

SEQ ID NO: 1328 - protein, 34 aa, synthetic construct
  REGION 1..34: note = Synthetic
FKELERAGQRVRDAIISAGPAVATVGQAAAIARG

SEQ ID NO: 1329 - protein, 34 aa, synthetic construct
  REGION 1..34: note = Synthetic
FKELERAGQRVRDAIISAAPAVATVGQAAAIARG

SEQ ID NO: 1330 - protein, 33 aa, synthetic construct
  REGION 1..33: note = Synthetic
GIFDVVKGVLKGVGKNVAGSLLEQLKCKLSGGC

SEQ ID NO: 1331 - protein, 16 aa, synthetic construct
  REGION 1..16: note = Synthetic
RLQKIIQKILKKAKSS

SEQ ID NO: 1332 - protein, 14 aa, synthetic construct
  REGION 1..14: note = Synthetic
LEKLAKKFKGCKNK

SEQ ID NO: 1333 - protein, 14 aa, synthetic construct
  REGION 1..14: note = Synthetic
LEKLAKKFKGCKNK

SEQ ID NO: 1334 - protein, 19 aa, synthetic construct
  REGION 1..19: note = Synthetic
EKAADKAKKFGGKIKKWFG

SEQ ID NO: 1335 - protein, 21 aa, synthetic construct
  REGION 1..21: note = Synthetic
TIVEFLNKWITFCQSIFSTMT

SEQ ID NO: 1336 - protein, 16 aa, synthetic construct
  REGION 1..16: note = Synthetic
LSSVARTMIKRLEHFI

SEQ ID NO: 1337 - protein, 21 aa, synthetic construct
  REGION 1..21: note = Synthetic
GNGKRGCSRWCRDHSRCCGRR

SEQ ID NO: 1338 - protein, 20 aa, synthetic construct
  REGION 1..20: note = Synthetic
LRQYLKELNEYYAIMGRTRF

SEQ ID NO: 1339 - protein, 26 aa, synthetic construct
  REGION 1..26: note = Synthetic
VIDDLKKVAKKVRRELLCKKHHKKLN

SEQ ID NO: 1340 - protein, 28 aa, synthetic construct
  REGION 1..28: note = Synthetic
LCQQLISDIRNLQQKIRKCVCGEPQWMI

SEQ ID NO: 1341 - protein, 21 aa, synthetic construct
  REGION 1..21: note = Synthetic
EVAQFISKLLNYSKQLFRYGH

SEQ ID NO: 1342 - protein, 34 aa, synthetic construct
  REGION 1..34: note = Synthetic
KDCCHVINDLADDCFPIIFPGKPYIAALVKHACS

SEQ ID NO: 1343 - protein, 12 aa, synthetic construct
  REGION 1..12: note = Synthetic
INEAKDFLDKAK

SEQ ID NO: 1344 - protein, 22 aa, synthetic construct
  REGION 1..22: note = Synthetic
LDRICEDCYNLFREPQVHSLCM

SEQ ID NO: 1345 - protein, 39 aa, synthetic construct
  REGION 1..39: note = Synthetic
LLRGVLHMLDALLVHIEGHLRHLATQRQIQIKGTSTQSG

SEQ ID NO: 1346 - protein, 29 aa, synthetic construct
  REGION 1..29: note = Synthetic
SEFFNRLESLVQRLSGKLLCCHLVDLVPS

SEQ ID NO: 1347 - protein, 13 aa, synthetic construct
  REGION 1..13: note = Synthetic
KWVQDYIKDMKEN

SEQ ID NO: 1348 - protein, 14 aa, synthetic construct
  REGION 1..14: note = Synthetic
LNKAVGKVVDFVKS

SEQ ID NO: 1349 - protein, 18 aa, synthetic construct
  REGION 1..18: note = Synthetic
MKQIGTCVGRAVKCCRKK

SEQ ID NO: 1350 - protein, 16 aa, synthetic construct
  REGION 1..16: note = Synthetic
MLRDLRDAFSRVKTFF

SEQ ID NO: 1351 - protein, 29 aa, synthetic construct
  REGION 1..29: note = Synthetic
WKDWLKKGKEWLKAKGPGIVKAALQAATQ

SEQ ID NO: 1352 - protein, 12 aa, synthetic construct
  REGION 1..12: note = Synthetic
HCIKSIGRCVAH

SEQ ID NO: 1353 - protein, 20 aa, synthetic construct
  REGION 1..20: note = Synthetic
FLDALKKFAKGGMNAVLNPK

SEQ ID NO: 1354 - protein, 27 aa, synthetic construct
  REGION 1..27: note = Synthetic
SCWTRVTSAFESITQLFRLYFARRLVG

SEQ ID NO: 1355 - protein, 18 aa, synthetic construct
  REGION 1..18: note = Synthetic
FIKKLMTFIQKVLKNTRV

SEQ ID NO: 1356 - protein, 12 aa, synthetic construct
  REGION 1..12: note = Synthetic
HCIKSIGRCVAH

SEQ ID NO: 1357 - protein, 20 aa, synthetic construct
  REGION 1..20: note = Synthetic
MAKYAAELRRYINRLTRPRY

SEQ ID NO: 1358 - protein, 34 aa, synthetic construct
  REGION 1..34: note = Synthetic
IQNLYNIITRICYRVGASGGLVTFSLLSSSCSSS

SEQ ID NO: 1359 - protein, 12 aa, synthetic construct
  REGION 1..12: note = Synthetic
AVLNKVTDMVNQ

SEQ ID NO: 1360 - protein, 19 aa, synthetic construct
  REGION 1..19: note = Synthetic
EKAADKAKKFGGKIKKWFG

SEQ ID NO: 1361 - protein, 19 aa, synthetic construct
  REGION 1..19: note = Synthetic
EKAADKAKKFGGKIKKWFG

SEQ ID NO: 1362 - protein, 16 aa, synthetic construct
  REGION 1..16: note = Synthetic
MLRDLRDAFSRVKTFF

SEQ ID NO: 1363 - protein, 33 aa, synthetic construct
  REGION 1..33: note = Synthetic
GLFDVVKGVLKGVGKNVAGSLLEQLKCKLSGGC

SEQ ID NO: 1364 - protein, 35 aa, synthetic construct
  REGION 1..35: note = Synthetic
IEKWEKIIYNICNNAFLLKGSMPINLRKRHKWMNI

SEQ ID NO: 1365 - protein, 37 aa, synthetic construct
  REGION 1..37: note = Synthetic
RKAINELIKVMNDLSPKSNLRKRKRSQNLFRGRRASM

SEQ ID NO: 1366 - protein, 19 aa, synthetic construct
  REGION 1..19: note = Synthetic
EKAADKAKKFGGKIKKWFG

SEQ ID NO: 1367 - protein, 19 aa, synthetic construct
  REGION 1..19: note = Synthetic
EKAADKAKKFGGKIKKWFG

SEQ ID NO: 1368 - protein, 11 aa, synthetic construct
  REGION 1..11: note = Synthetic
AVKKYLNSVLT

SEQ ID NO: 1369 - protein, 11 aa, synthetic construct
  REGION 1..11: note = Synthetic
AVKKYLNSVLT

SEQ ID NO: 1370 - protein, 11 aa, synthetic construct
  REGION 1..11: note = Synthetic
AVKKYLNSVLT

SEQ ID NO: 1371 - protein, 11 aa, synthetic construct
  REGION 1..11: note = Synthetic
AVKKYLNSVLT

SEQ ID NO: 1372 - protein, 15 aa, synthetic construct
  REGION 1..15: note = Synthetic
ILSFIKGLAEHLGKK

SEQ ID NO: 1373 - protein, 38 aa, synthetic construct
  REGION 1..38: note = Synthetic
LEEARQAFQTFKPDWNKIRYDAMKMQTSLGQMKKRFNL

SEQ ID NO: 1374 - protein, 12 aa, synthetic construct
  REGION 1..12: note = Synthetic
YSKVLAIAQNFV

SEQ ID NO: 1375 - protein, 37 aa, synthetic construct
  REGION 1..37: note = Synthetic
RKAINELIKVMNDLSPRSNLRKRKRSQNLFRGRRASK

SEQ ID NO: 1376 - protein, 37 aa, synthetic construct; identical to SEQ ID NO: 1375
  REGION 1..37: note = Synthetic

SEQ ID NO: 1377 - protein, 19 aa, synthetic construct
  REGION 1..19: note = Synthetic
EKAVDKAKKFGGKIKKWFG

SEQ ID NO: 1378 - protein, 24 aa, synthetic construct
  REGION 1..24: note = Synthetic
LDTLKGLAGKLLQGLKCIKAGCKP

SEQ ID NO: 1379 - protein, 33 aa, synthetic construct
  REGION 1..33: note = Synthetic
RKAVSELFSVLQKLVETSTSKRKRSQSPKRCRC

SEQ ID NO: 1380 - protein, 29 aa, synthetic construct
  REGION 1..29: note = Synthetic
FLKGVGTTLASVGKVVSDQFGKLLQAGQG

SEQ ID NO: 1381 - protein, 15 aa, synthetic construct
  REGION 1..15: note = Synthetic
IKKIVQKILDSGKNN

SEQ ID NO: 1382 - protein, 15 aa, synthetic construct
  REGION 1..15: note = Synthetic
DCCSDFCSTMSDVCQ

SEQ ID NO: 1383 - protein, 32 aa, synthetic construct
  REGION 1..32: note = Synthetic
GILSTFKGLAKGVAKDLAGNLLDKFKCKITGC

SEQ ID NO: 1384 - protein, 16 aa, synthetic construct
  REGION 1..16: note = Synthetic
LKKVIQKILDSGNKKN

SEQ ID NO: 1385 - protein, 21 aa, synthetic construct
  REGION 1..21: note = Synthetic
LKDFLENLKRIMQKRYSKCRR

SEQ ID NO: 1386 - protein, 34 aa, synthetic construct
  REGION 1..34: note = Synthetic
RKAVHELFSVLQRLVETPTAFKRKRSQSQRRCKC

SEQ ID NO: 1387 - protein, 19 aa, synthetic construct
  REGION 1..19: note = Synthetic
KWVQNYMKHLGRKAHTLKT

SEQ ID NO: 1388 - protein, 28 aa, synthetic construct
  REGION 1..28: note = Synthetic
ILDSLKNFAKDAAGILLKKASCKLSGQC

SEQ ID NO: 1389 - protein, 11 aa, synthetic construct
  REGION 1..11: note = Synthetic
ELVSGIVEGVK

SEQ ID NO: 1390 - protein, 11 aa, synthetic construct
  REGION 1..11: note = Synthetic
ELVSGIVEGVK

SEQ ID NO: 1391 - protein, 11 aa, synthetic construct
  REGION 1..11: note = Synthetic
ELVSGIVEGVK

SEQ ID NO: 1392 - protein, 28 aa, synthetic construct
  REGION 1..28: note = Synthetic
KQIFYRLDRICEDCYSLFQEPQILSFCK

SEQ ID NO: 1393 - protein, 36 aa, synthetic construct
  REGION 1..36: note = Synthetic
LFSVVTGVLKAVGKNVAKNVGGSLLEQLKCKISGGC

SEQ ID NO: 1394 - protein, 24 aa, synthetic construct
  REGION 1..24: note = Synthetic
LLKELWTKMKGAGKAVLGKIKGLL

SEQ ID NO: 1395 - protein, 22 aa, synthetic construct
  REGION 1..22: note = Synthetic
RQFLDYLQEFLGVMGTEWTMEH

SEQ ID NO: 1396 - protein, 21 aa, synthetic construct
  REGION 1..21: note = Synthetic
STLKDLLERLKTIMKEKYSKC

SEQ ID NO: 1397 - protein, 32 aa, synthetic construct
  REGION 1..32: note = Synthetic
QQVQHVFQTAKNLPNVCKIPTVGSCQFKASPY

SEQ ID NO: 1398 - protein, 37 aa, synthetic construct
  REGION 1..37: note = Synthetic
RKAINELIKVMNDLSPRSNLRKRKRSHSLFRGRRASK

SEQ ID NO: 1399 - protein, 37 aa, synthetic construct
  REGION 1..37: note = Synthetic
RKAINELIKVMNDLSPRSNLTKRKRSQNLFRGRRASK

SEQ ID NO: 1400 - protein, 37 aa, synthetic construct; identical to SEQ ID NO: 1365
  REGION 1..37: note = Synthetic

SEQ ID NO: 1401 - protein, 37 aa, synthetic construct; identical to SEQ ID NO: 1365
  REGION 1..37: note = Synthetic

SEQ ID NO: 1402 - protein, 37 aa, synthetic construct
  REGION 1..37: note = Synthetic
RKAINELIKVMNDLSPKSNLRKRKRSQNLFRGRRAST

SEQ ID NO: 1403 - protein, 37 aa, synthetic construct; identical to SEQ ID NO: 1365
  REGION 1..37: note = Synthetic

SEQ ID NO: 1404 - protein, 16 aa, synthetic construct
  REGION 1..16: note = Synthetic
NLLRQLHTIMRDIENN

SEQ ID NO: 1405 - protein, 31 aa, synthetic construct
  REGION 1..31: note = Synthetic
KWNNAVDSVFTTIENVPSSVNTVANRLINNK

SEQ ID NO: 1406 - protein, 26 aa, synthetic construct
  REGION 1..26: note = Synthetic
FFTELGASLASLFTSWFPTTTTERNH

SEQ ID NO: 1407 - protein, 26 aa, synthetic construct
  REGION 1..26: note = Synthetic
FFTELGASLASLFTSWFPATTTERNH

SEQ ID NO: 1408 - protein, 12 aa, synthetic construct
  REGION 1..12: note = Synthetic
IATGIAALAKHL

SEQ ID NO: 1409 - protein, 26 aa, synthetic construct
  REGION 1..26: note = Synthetic
ALWKDMLSGIGKLAGQAALGAVKTLV

SEQ ID NO: 1410 - protein, 37 aa, synthetic construct; identical to SEQ ID NO: 1365
  REGION 1..37: note = Synthetic

SEQ ID NO: 1411 - protein, 12 aa, synthetic construct
  REGION 1..12: note = Synthetic
LFDIIKKIAESI

SEQ ID NO: 1412 - protein, 18 aa, synthetic construct
  REGION 1..18: note = Synthetic
FDRVLQELKDIARENLGS

SEQ ID NO: 1413 - protein, 12 aa, synthetic construct
  REGION 1..12: note = Synthetic
LFDIIKKIAESF

SEQ ID NO: 1414 - protein, 16 aa, synthetic construct
  REGION 1..16: note = Synthetic
GALKGLAKGLAEHFAN

SEQ ID NO: 1415 - protein, 35 aa, synthetic construct
  REGION 1..35: note = Synthetic
RLASLLETLIKEAEKLTQCTRRLNAIDGLTDIFQR

SEQ ID NO: 1416 - protein, 26 aa, synthetic construct
  REGION 1..26: note = Synthetic
IYEMLKDIFHVFKKGYSNPDWNNTIV

SEQ ID NO: 1417 - protein, 26 aa, synthetic construct
  REGION 1..26: note = Synthetic
IYEMLKDIFHVFKKGYSNPDWNNTIV

SEQ ID NO: 1418 - protein, 28 aa, synthetic construct
  REGION 1..28: note = Synthetic
LWSKIKTAGKSVAKAAAKAAVKAVTNAV

SEQ ID NO: 1419 - protein, 19 aa, synthetic construct
  REGION 1..19: note = Synthetic
EKAADKAKKFGGKIKRWFG

SEQ ID NO: 1420 - protein, 38 aa, synthetic construct; identical to SEQ ID NO: 1373
  REGION 1..38: note = Synthetic

SEQ ID NO: 1421 - protein, 28 aa, synthetic construct
  REGION 1..28: note = Synthetic
AVWKDFLKNIGKAAGKAVLNSVTDMVNE

SEQ ID NO: 1422 - protein, 28 aa, synthetic construct
  REGION 1..28: note = Synthetic
ILDSLKNLAKNAAQILLNKASCKLSGQC

SEQ ID NO: 1423 - protein, 32 aa, synthetic construct
  REGION 1..32: note = Synthetic
LISAVRTLMRTWKSLTIRYSTPHRYQYTGHTV

SEQ ID NO: 1424 - protein, 28 aa, synthetic construct
  REGION 1..28: note = Synthetic
ILDSLKNLAKNAGQILLNKASCKLSGQC

SEQ ID NO: 1425 - protein, 23 aa, synthetic construct
  REGION 1..23: note = Synthetic
EVIQLVKNLLTYVRGVYRHGNFR

SEQ ID NO: 1426 - protein, 13 aa, synthetic construct
  REGION 1..13: note = Synthetic
ILDAIKAIAKAAG

SEQ ID NO: 1427 - protein, 22 aa, synthetic construct
  REGION 1..22: note = Synthetic
VANPYRRGCGTIERCRRDTGRK

SEQ ID NO: 1428 - protein, 19 aa, synthetic construct
  REGION 1..19: note = Synthetic
EKAADKAKKFGGKIKKWFG

SEQ ID NO: 1429 - protein, 19 aa, synthetic construct
  REGION 1..19: note = Synthetic
EKAADKAKKFGGKIKKWFG

SEQ ID NO: 1430 - protein, 19 aa, synthetic construct
  REGION 1..19: note = Synthetic
EKAADKAKKFGGKIKKWFG

SEQ ID NO: 1431 - protein, 19 aa, synthetic construct
  REGION 1..19: note = Synthetic
EKAADKAKKFGGKIKKWFG

SEQ ID NO: 1432 - protein, 19 aa, synthetic construct
  REGION 1..19: note = Synthetic
EKAADKAKKFGGKIKKWFG

SEQ ID NO: 1433 - protein, 19 aa, synthetic construct
  REGION 1..19: note = Synthetic
EKAADKAKKFGGKIKKWFG

SEQ ID NO: 1434 - protein, 19 aa, synthetic construct
  REGION 1..19: note = Synthetic
EKAADKAKKFGGKIKKWFG

SEQ ID NO: 1435 - protein, 19 aa, synthetic construct
  REGION 1..19: note = Synthetic
EKAADKAKKFGGKIKKWFG

SEQ ID NO: 1436 - protein, 19 aa, synthetic construct
  REGION 1..19: note = Synthetic
EKAADKAKKFGGKIKKWFG

SEQ ID NO: 1437 - protein, 20 aa, synthetic construct
  REGION 1..20: note = Synthetic
HEFLNSLRSFLQKVFLLLFS

SEQ ID NO: 1438 - protein, 20 aa, synthetic construct
  REGION 1..20: note = Synthetic
ARSCCSRLGRCCREAKGYSG

SEQ ID NO: 1439 - protein, 23 aa, synthetic construct
  REGION 1..23: note = Synthetic
EAIAAIYKAIQNEAERFIMCQKN

SEQ ID NO: 1440 - protein, 31 aa, synthetic construct
  REGION 1..31: note = Synthetic
LGGFLKGVGKVLAGVGKVVADQFGNLLEAGQ

SEQ ID NO: 1441 - protein, 25 aa, synthetic construct
  REGION 1..25: note = Synthetic
LLQQLQQLLQQLQQLLLLPLYRNAN

SEQ ID NO: 1442 - protein, 32 aa, synthetic construct
  REGION 1..32: note = Synthetic
MRNYMKRYLNLGESVYDYSVATCGSSTYFARK

SEQ ID NO: 1443 - protein, 28 aa, synthetic construct
  REGION 1..28: note = Synthetic
DCYRRFEKGVEKGQKCWCIETGVTFSKE

SEQ ID NO: 1444 - protein, 28 aa, synthetic construct
  REGION 1..28: note = Synthetic
DCYRRFEKGVEKGQKCWCIETGVTFSKE

SEQ ID NO: 1445 - protein, 23 aa, synthetic construct
  REGION 1..23: note = Synthetic
FLKRLLQEIKTCWNKILMGTKEH

SEQ ID NO: 1446 - protein, 33 aa, synthetic construct
  REGION 1..33: note = Synthetic
IFTECKSACEKLKKPVASLCLPPKTCRCYHFCS

SEQ ID NO: 1447 - protein, 23 aa, synthetic construct
  REGION 1..23: note = Synthetic
IRYILHSFLKVLHHLREQKGKCA

SEQ ID NO: 1448 - protein, 16 aa, synthetic construct
  REGION 1..16: note = Synthetic
LEYMEKAADKIKNLFG

SEQ ID NO: 1449 - protein, 33 aa, synthetic construct
  REGION 1..33: note = Synthetic
ASVRKMCEKCRTIRRKGRVMVICSNSKHKQRQG

SEQ ID NO: 1450 - protein, 19 aa, synthetic construct
  REGION 1..19: note = Synthetic
EKAADKAKKFGGKIKKWFG

SEQ ID NO: 1451 - protein, 37 aa, synthetic construct
  REGION 1..37: note = Synthetic
RKAISELIRVMKDLSPRSNLRKRRRSQNLFRGQRASK

SEQ ID NO: 1452 - protein, 13 aa, synthetic construct
  REGION 1..13: note = Synthetic
IPGAISAIASLFK

SEQ ID NO: 1453 - protein, 28 aa, synthetic construct
  REGION 1..28: note = Synthetic
ALWKTLLKNVGKAAGKAALNAVTDMVNQ

SEQ ID NO: 1454 - protein, 33 aa, synthetic construct
  REGION 1..33: note = Synthetic
GLLSGLKKVGKHVAKNVAVSLMDSLKCKISGDC

SEQ ID NO: 1455 - protein, 25 aa, synthetic construct
  REGION 1..25: note = Synthetic
FFTELGASLASILTSWFPANTERNH

SEQ ID NO: 1456 - protein, 37 aa, synthetic construct
  REGION 1..37: note = Synthetic
RKAISELIKVMNDLSPKANLRKRKRSQNPFRGRRALQ

SEQ ID NO: 1457 - protein, 37 aa, synthetic construct; identical to SEQ ID NO: 1456
  REGION 1..37: note = Synthetic

SEQ ID NO: 1458 - protein, 23 aa, synthetic construct
  REGION 1..23: note = Synthetic
STLEDFLERLKTIMKEKYSKCRR

SEQ ID NO: 1459 - protein, 23 aa, synthetic construct
  REGION 1..23: note = Synthetic
STLEDFLERLKTIMKEKYSKCRR

SEQ ID NO: 1460 - protein, 20 aa, synthetic construct
  REGION 1..20: note = Synthetic
KEFLERLKSLIQRMIYQHLS

SEQ ID NO: 1461 - protein, 35 aa, synthetic construct
  REGION 1..35: note = Synthetic
LWSKIKEVGKEAAKAAAKAAGKAALGAVSEAVGEQ

SEQ ID NO: 1462 - protein, 30 aa, synthetic construct
  REGION 1..30: note = Synthetic
GWKDWAKKAGGWLKKKGPGMAKAALKAAMQ

SEQ ID NO: 1463 - protein, 13 aa, synthetic construct
  REGION 1..13: note = Synthetic
YSRGCSAITRCRR

SEQ ID NO: 1464 - protein, 28 aa, synthetic construct
  REGION 1..28: note = Synthetic
EVTQFIKTLLQHSRNVFHYRSFNWSKKS

SEQ ID NO: 1465 - protein, 28 aa, synthetic construct
  REGION 1..28: note = Synthetic
EVTQFIKTLLQHSRNVFHYRSFNWSKKS

SEQ ID NO: 1466 - protein, 22 aa, synthetic construct
  REGION 1..22: note = Synthetic
ILSAGKSALKGLAKGLAEHFAN

SEQ ID NO: 1467 - protein, 36 aa, synthetic construct
  REGION 1..36: note = Synthetic
QMVSRIYQTATHLPKVCNIPQVSVCPFQKTMPGPSY

SEQ ID NO: 1468 - protein, 35 aa, synthetic construct; identical to SEQ ID NO: 5
  REGION 1..35: note = Synthetic

SEQ ID NO: 1469 - protein, 33 aa, synthetic construct
  REGION 1..33: note = Synthetic
FLDQIIRDFRNFIYQKYRRLRDEFRKLRDILSG

SEQ ID NO: 1470 - protein, 17 aa, synthetic construct
  REGION 1..17: note = Synthetic
KIKRMIQKMLSSAERTA

SEQ ID NO: 1471 - protein, 15 aa, synthetic construct
  REGION 1..15: note = Synthetic
RFASHISKCLERKRK

SEQ ID NO: 1472 - protein, 23 aa, synthetic construct
  REGION 1..23: note = Synthetic
EVAQFLKDLLRHSRIVFRNERFN

SEQ ID NO: 1473 - protein, 18 aa, synthetic construct
  REGION 1..18: note = Synthetic
LQSILELVHRVLRHLAQP

SEQ ID NO: 1474 - protein, 24 aa, synthetic construct
  REGION 1..24: note = Synthetic
RALSAICEVASETCTAWMSRQESN

SEQ ID NO: 1475 - protein, 21 aa, synthetic construct
  REGION 1..21: note = Synthetic
STLRDFLERLKAIVQRKYYRH

SEQ ID NO: 1476 - protein, 21 aa, synthetic construct
  REGION 1..21: note = Synthetic
STLKNLLERLKTIMKEKYSKC

SEQ ID NO: 1477 - protein, 21 aa, synthetic construct
  REGION 1..21: note = Synthetic
STLKNLLERLKTIMKEKYSKC

SEQ ID NO: 1478 - protein, 17 aa, synthetic construct
  REGION 1..17: note = Synthetic
DLLERLKTIMKEKYSKC

SEQ ID NO: 1479 - protein, 17 aa, synthetic construct
  REGION 1..17: note = Synthetic
DLLERLKTIMKEKYSKC

SEQ ID NO: 1480 - protein, 17 aa, synthetic construct
  REGION 1..17: note = Synthetic
DLLERLKTIMKEKYSKC

SEQ ID NO: 1481 - protein, 21 aa, synthetic construct
  REGION 1..21: note = Synthetic
IGSALKVLAGVLPSIVSWVKQ

SEQ ID NO: 1482 - protein, 20 aa, synthetic construct
  REGION 1..20: note = Synthetic
KEFLERLKSLLQKMIHQRLS

SEQ ID NO: 1483 - protein, 24 aa, synthetic construct
  REGION 1..24: note = Synthetic
LASTLGSFLGKFAKGGAQAFLQPK

SEQ ID NO: 1484 - protein, 21 aa, synthetic construct
  REGION 1..21: note = Synthetic
STLKDLLERLKTIMKEKYSKC

SEQ ID NO: 1485 - protein, 21 aa, synthetic construct
  REGION 1..21: note = Synthetic
STLKDLLERLKTIMKEKYSKC

SEQ ID NO: 1486 - protein, 21 aa, synthetic construct
  REGION 1..21: note = Synthetic
STLKDLLERLKTIMKEKYSKC

SEQ ID NO: 1487 - protein, 21 aa, synthetic construct
  REGION 1..21: note = Synthetic
STLKDLLERLKTIMKEKYSKC

SEQ ID NO: 1488 - protein, 21 aa, synthetic construct
  REGION 1..21: note = Synthetic
STLKDLLERLKTIMKEKYSKC

SEQ ID NO: 1489 - protein, 21 aa, synthetic construct
  REGION 1..21: note = Synthetic
STLKDLLERLKTIMKEKYSKC

SEQ ID NO: 1490 - protein, 21 aa, synthetic construct
  REGION 1..21: note = Synthetic
STLKDLLERLKTIMKEKYSKC

SEQ ID NO: 1491 - protein, 21 aa, synthetic construct
  REGION 1..21: note = Synthetic
STLKDLLERLKTIMKEKYSKC

SEQ ID NO: 1492 - protein, 21 aa, synthetic construct
  REGION 1..21: note = Synthetic
STLKDLLERLKTIMKEKYSKC

SEQ ID NO: 1493 - protein, 21 aa, synthetic construct
  REGION 1..21: note = Synthetic
STLKDLLERLKTIMKEKYSKC

SEQ ID NO: 1494 - protein, 21 aa, synthetic construct
  REGION 1..21: note = Synthetic
STLKDLLERLKTIMKEKYSKC

SEQ ID NO: 1495 - protein, 40 aa, synthetic construct
  REGION 1..40: note = Synthetic
MLDGLNDYCTGITSDCPRNPWKSEEDEMKWSATAKGSVLM

SEQ ID NO: 1496 - protein, 21 aa, synthetic construct
  REGION 1..21: note = Synthetic
LNRLKQFMQKLIDNLDQLKIC

SEQ ID NO: 1497 - protein, 23 aa, synthetic construct
  REGION 1..23: note = Synthetic
FLKRLLQEIKTCWNKILSGTKEH

SEQ ID NO: 1498 - protein, 36 aa, synthetic construct
  REGION 1..36: note = Synthetic
IFTLIKGAAKLIGKTVAKEAGKTGLELMACKITNQC

SEQ ID NO: 1499 - protein, 32 aa, synthetic construct
  REGION 1..32: note = Synthetic
RSIWEGIKNAGKGFLVSILDKVRCKVAGGCNP

SEQ ID NO: 1500 - protein, 23 aa, synthetic construct
  REGION 1..23: note = Synthetic
KNATTFIKKLMTFIRKASKPARV

SEQ ID NO: 1501 - protein, 21 aa, synthetic construct
  REGION 1..21: note = Synthetic
STLKDFLERLKTIMKEKYSKC

SEQ ID NO: 1502 - protein, 14 aa, synthetic construct
  REGION 1..14: note = Synthetic
YRRGCSKITRCKRD

SEQ ID NO: 1503 - protein, 36 aa, synthetic construct
  REGION 1..36: note = Synthetic
QMVSRIYQTATHLPKVCKIPQVSVCPFQKTMPGPSY

SEQ ID NO: 1504 - protein, 12 aa, synthetic construct
  REGION 1..12: note = Synthetic
GIGSCCARGWRS

SEQ ID NO: 1505 - protein, 37 aa, synthetic construct
  REGION 1..37: note = Synthetic
RKAISELIKVMNDLSPRSNLRKRKRSQTMFQGQRASK

SEQ ID NO: 1506 - protein, 28 aa, synthetic construct
  REGION 1..28: note = Synthetic
KYWTECCGRIGPHCSRCICPEVACPKNG

SEQ ID NO: 1507 - protein, 12 aa, synthetic construct
  REGION 1..12: note = Synthetic
ALVGQFGKMLNE

SEQ ID NO: 1508 - protein, 18 aa, synthetic construct
  REGION 1..18: note = Synthetic
KCVRFVKKVGEKVIEKVG

SEQ ID NO: 1509 - protein, 37 aa, synthetic construct
  REGION 1..37: note = Synthetic
RKAINELFKVMNDLSPRSNLRKRKRSQNLFRGRRASK

SEQ ID NO: 1510 - protein, 28 aa, synthetic construct
  REGION 1..28: note = Synthetic
LWSKIKEAGKAAVKAAGKAALGAVANSV

SEQ ID NO: 1511 - protein, 13 aa, synthetic construct
  REGION 1..13: note = Synthetic
NVLHSIISICRIF

SEQ ID NO: 1512 - protein, 17 aa, synthetic construct
  REGION 1..17: note = Synthetic
DLLERLKTIMREKYSKC

SEQ ID NO: 1513 - protein, 13 aa, synthetic construct
  REGION 1..13: note = Synthetic
KWVREYINTLEMS

SEQ ID NO: 1514 - protein, 24 aa, synthetic construct
  REGION 1..24: note = Synthetic
IPAYYKRCARLLTRLAVSPMCMER

SEQ ID NO: 1515 - protein, 24 aa, synthetic construct
  REGION 1..24: note = Synthetic
IPAYYKRCARLLTRLAVSPMCMER

SEQ ID NO: 1516 - protein, 21 aa, synthetic construct
  REGION 1..21: note = Synthetic
STLRDLLERLKTIMREKYSKC

SEQ ID NO: 1517 - protein, 42 aa, synthetic construct
  REGION 1..42: note = Synthetic
FGNTMGDKAREVIDRIKQSDIPAKTRNWFSETFQKVKEKLKI

SEQ ID NO: 1518 - protein, 23 aa, synthetic construct
  REGION 1..23: note = Synthetic
STLEDFLERLKTIMKEKYSKCRS

SEQ ID NO: 1519 - protein, 23 aa, synthetic construct
  REGION 1..23: note = Synthetic
STLEDFLERLKTIMKEKYSKCRS

SEQ ID NO: 1520 - protein, 23 aa, synthetic construct
  REGION 1..23: note = Synthetic
STLEDFLERLKTIMKEKYSKCRS

SEQ ID NO: 1521 - protein, 24 aa, synthetic construct
  REGION 1..24: note = Synthetic
TTVKKAVKYLRTIMKSHDPRVQES

SEQ ID NO: 1522 - protein, 14 aa, synthetic construct
  REGION 1..14: note = Synthetic
TVKNCGKKLLATPR

SEQ ID NO: 1523 - protein, 37 aa, synthetic construct
  REGION 1..37: note = Synthetic
RKAISELIKVMNDLSPKSNLRKRKRRQNQIQGRRASK

SEQ ID NO: 1524 - protein, 12 aa, synthetic construct
  REGION 1..12: note = Synthetic
SFLTRLTGYLRE

SEQ ID NO: 1525 - protein, 23 aa, synthetic construct
  REGION 1..23: note = Synthetic
STLENFLERLKTIMREKYSKCSS

SEQ ID NO: 1526 - protein, 24 aa, synthetic construct
  REGION 1..24: note = Synthetic
LVSSIGRALGGLLADVVKSKEQPA

SEQ ID NO: 1527 - protein, 24 aa, synthetic construct
  REGION 1..24: note = Synthetic
LVSSIGRALGGLLADVVKSKEQPA

SEQ ID NO: 1528 - protein, 23 aa, synthetic construct
  REGION 1..23: note = Synthetic
STLEDFLERLKTIMREKYSKCSS

SEQ ID NO: 1529 - protein, 17 aa, synthetic construct
  REGION 1..17: note = Synthetic
IVEFLNRWITFCQSIIS

SEQ ID NO: 1530 - protein, 29 aa, synthetic construct
  REGION 1..29: note = Synthetic
RGIMDTVKNAAKDLAGQLLDKLKCKITAC

SEQ ID NO: 1531 - protein, 17 aa, synthetic construct
  REGION 1..17: note = Synthetic
RLFDNILGDVVQIPRVA

SEQ ID NO: 1532 - protein, 21 aa, synthetic construct
  REGION 1..21: note = Synthetic
STLKDFLERLKTIMREKYSKC

SEQ ID NO: 1533 - protein, 13 aa, synthetic construct
  REGION 1..13: note = Synthetic
YSRGCSSITRCRR

SEQ ID NO: 1534 - protein, 37 aa, synthetic construct
  REGION 1..37: note = Synthetic
RKAINELIKVMNDLSPKSNLIKRKRSQNLFRGRRASM

SEQ ID NO: 1535 - protein, 19 aa, synthetic construct
  REGION 1..19: note = Synthetic
LKDFLERLKAIMQKKYSKH

SEQ ID NO: 1536 - protein, 21 aa, synthetic construct
  REGION 1..21: note = Synthetic
STLRDLLERLKTIMKEKYSKC

SEQ ID NO: 1537 - protein, 21 aa, synthetic construct
  REGION 1..21: note = Synthetic
STLRDLLERLKTIMKEKYSKC

SEQ ID NO: 1538 - protein, 34 aa, synthetic construct
  REGION 1..34: note = Synthetic
RGILDTLKHLAKTAGKGALQSLLNHASCKLSGQC

SEQ ID NO: 1539 - protein, 23 aa, synthetic construct
  REGION 1..23: note = Synthetic
STLENFLERLKTIMREKYSKCSS

SEQ ID NO: 1540 - protein, 23 aa, synthetic construct
  REGION 1..23: note = Synthetic
STLENFLERLKTIMREKYSKCSS

SEQ ID NO: 1541 - protein, 21 aa, synthetic construct
  REGION 1..21: note = Synthetic
STLKDFLERLKTIMKEKYSKC

SEQ ID NO: 1542 - protein, 21 aa, synthetic construct
  REGION 1..21: note = Synthetic
STLKDFLERLKTIMKEKYSKC

SEQ ID NO: 1543 - protein, 22 aa, synthetic construct
  REGION 1..22: note = Synthetic
STLKDFLERLKTIMKEKYSKCQ

SEQ ID NO: 1544 - protein, 22 aa, synthetic construct
  REGION 1..22: note = Synthetic
STLKDFLERLKTIMKEKYSKCS

SEQ ID NO: 1545 - protein, 22 aa, synthetic construct
  REGION 1..22: note = Synthetic
STLKDFLERLKTIMKEKYSKCS

SEQ ID NO: 1546 - protein, 15 aa, synthetic construct
  REGION 1..15: note = Synthetic
QLHSLCRSVFSSISN

SEQ ID NO: 1547 - protein, 11 aa, synthetic construct
  REGION 1..11: note = Synthetic
INAVSAIAKHF

SEQ ID NO: 1548 - protein, 22 aa, synthetic construct
  REGION 1..22: note = Synthetic
FKKVLHFIQKGISKLKSCKEGN

SEQ ID NO: 1549 - protein, 36 aa, synthetic construct
  REGION 1..36: note = Synthetic
LFTLIKGAAKLIGKTVAKEAGKTGLELMACKITNQC

SEQ ID NO: 1550 - protein, 14 aa, synthetic construct
  REGION 1..14: note = Synthetic
ALERCMSLWRDCAH

SEQ ID NO: 1551 - protein, 22 aa, synthetic construct
  REGION 1..22: note = Synthetic
FKKVLHFIQKGISKLKSCKEGN

SEQ ID NO: 1552 - protein, 12 aa, synthetic construct
  REGION 1..12: note = Synthetic
AIAGLVGGLINR

SEQ ID NO: 1553 - protein, 13 aa, synthetic construct
  REGION 1..13: note = Synthetic
KWVREYINSLEMS

SEQ ID NO: 1554 - protein, 20 aa, synthetic construct
  REGION 1..20: note = Synthetic
RLWRYFTRFLHKQPYYYVHI

SEQ ID NO: 1555 - protein, 36 aa, synthetic construct
  REGION 1..36: note = Synthetic
RGMWSTIRNVGKSAAKAANLPAKAALGAISEAVGEQ

SEQ ID NO: 1556 - protein, 13 aa, synthetic construct
  REGION 1..13: note = Synthetic
KTYTELFKEYFGK

SEQ ID NO: 1557 - protein, 22 aa, synthetic construct
  REGION 1..22: note = Synthetic
CKRCCSYAGEAIDKVTEAQPHN

SEQ ID NO: 1558 - protein, 22 aa, synthetic construct
  REGION 1..22: note = Synthetic
CKRCCSYAGEAIDKVTEAQPHN

SEQ ID NO: 1559 - protein, 16 aa, synthetic construct
  REGION 1..16: note = Synthetic
LNKWITFCQRIFSTLT

SEQ ID NO: 1560 - protein, 18 aa, synthetic construct
  REGION 1..18: note = Synthetic
NFLSLIKKIFSVWKREVI

SEQ ID NO: 1561 - protein, 19 aa, synthetic construct
  REGION 1..19: note = Synthetic
LKDFLENLKTILKKKYSEC

SEQ ID NO: 1562 - protein, 33 aa, synthetic construct
  REGION 1..33: note = Synthetic
TEVMEKFHRALETLPVPIQISLNFTQGKERCRV

SEQ ID NO: 1563 - protein, 37 aa, synthetic construct
  REGION 1..37: note = Synthetic
QVISRVYQTATHLPRVCNIRQVSICPFQKTMPGPGFY

SEQ ID NO: 1564 - protein, 38 aa, synthetic construct
  REGION 1..38: note = Synthetic
RGLFSILKGVGKIALKGLAKNMGKMGLDLVSCKISKEC

SEQ ID NO: 1565 - protein, 13 aa, synthetic construct
  REGION 1..13: note = Synthetic
KWVREYINSLEMS

SEQ ID NO: 1566 - protein, 13 aa, synthetic construct
  REGION 1..13: note = Synthetic
KWVREYINSLEMS

SEQ ID NO: 1567 - protein, 13 aa, synthetic construct
  REGION 1..13: note = Synthetic
YSRGCSTITRCRR

SEQ ID NO: 1568 - protein, 37 aa, synthetic construct
  REGION 1..37: note = Synthetic
RKAISELIKVMNDLSPKSNLRKRKRSQNLFRGRRASK

SEQ ID NO: 1569 - protein, 24 aa, synthetic construct
  REGION 1..24: note = Synthetic
IKGLGKNLGKMGLDLVSCKISKEC

SEQ ID NO: 1570 - protein, 36 aa, synthetic construct
  REGION 1..36: note = Synthetic
ILSLVKGAAKLLGKGLAKEGGKVGLEFIACKVTNQC

SEQ ID NO: 1571 - protein, 23 aa, synthetic construct
  REGION 1..23: note = Synthetic
STLEDFLERLKTIMREKYSKCSS

SEQ ID NO: 1572 - protein, 23 aa, synthetic construct
  REGION 1..23: note = Synthetic
STLEDFLERLKTIMREKYSKCSS

SEQ ID NO: 1573 - protein, 23 aa, synthetic construct
  REGION 1..23: note = Synthetic
STLEDFLERLKTIMREKYSKCSS

SEQ ID NO: 1574 - protein, 23 aa, synthetic construct
  REGION 1..23: note = Synthetic
STLEDFLERLKTIMREKYSKCSS

SEQ ID NO: 1575 - protein, 24 aa, synthetic construct
  REGION 1..24: note = Synthetic
KGCKKCCSYAGQAMDKVTETNSHN

SEQ ID NO: 1576 - protein, 31 aa, synthetic construct
  REGION 1..31: note = Synthetic
CYDCGKACFRRGKNLARCKKFVCRCTKSGIK

SEQ ID NO: 1577 - protein, 21 aa, synthetic construct
  REGION 1..21: note = Synthetic
DEAQKALQRLIDAVQAIIGSD

SEQ ID NO: 1578 - protein, 27 aa, synthetic construct
  REGION 1..27: note = Synthetic
ADQFANKWGRSGKDPNHFRPAGLPSKY

SEQ ID NO: 1579 - protein, 11 aa, synthetic construct
  REGION 1..11: note = Synthetic
HMRKGCSRCCS

SEQ ID NO: 1580 - protein, 15 aa, synthetic construct
  REGION 1..15: note = Synthetic
VQKIIEKILNKGSTN

SEQ ID NO: 1581 - protein, 36 aa, synthetic construct
  REGION 1..36: note = Synthetic
FFSLIKGVAKIATKGLAKNLGKMGLDLVGCKISKEC

SEQ ID NO: 1582 - protein, 13 aa, synthetic construct
  REGION 1..13: note = Synthetic
AKGIAKEFCNCPD

SEQ ID NO: 1583 - protein, 27 aa, synthetic construct
  REGION 1..27: note = Synthetic
ADQFANEWGRSGKDPNHFRPAGLPKRY

SEQ ID NO: 1584 - protein, 17 aa, synthetic construct
  REGION 1..17: note = Synthetic
DFLERLKTIMKEKYSKC

SEQ ID NO: 1585 - protein, 20 aa, synthetic construct
  REGION 1..20: note = Synthetic
RKAMENIVYMIHSFFLPFAS

SEQ ID NO: 1586 - protein, 11 aa, synthetic construct
  REGION 1..11: note = Synthetic
HVRKGCSRCCS

SEQ ID NO: 1587 - protein, 21 aa, synthetic construct
  REGION 1..21: note = Synthetic
STLKDFLERLKTIMKEKYSKC

SEQ ID NO: 1588 - protein, 21 aa, synthetic construct
  REGION 1..21: note = Synthetic
STLKDFLERLKTIMKEKYSKC

SEQ ID NO: 1589 - protein, 16 aa, synthetic construct
  REGION 1..16: note = Synthetic
FADLFGKAVDFIKSRV

SEQ ID NO: 1590 - protein, 24 aa, synthetic construct
  REGION 1..24: note = Synthetic
LVSSIGKALGGLLADVVKTKEQPA

SEQ ID NO: 1591 - protein, 31 aa, synthetic construct
  REGION 1..31: note = Synthetic
FLDIINKLGKTFAGHMLDKIKCTIGTCPPSP

SEQ ID NO: 1592 - protein, 23 aa, synthetic construct
  REGION 1..23: note = Synthetic
STLENFLERLKTIMREKYSKCSS

SEQ ID NO: 1593 - protein, 28 aa, synthetic construct
  REGION 1..28: note = Synthetic
KDWVKIAGGWLKKKGPGILKAAMAAATQ

SEQ ID NO: 1594 - protein, 15 aa, synthetic construct
  REGION 1..15: note = Synthetic
VQKVLQRMLKGSKAT

SEQ ID NO: 1595 - protein, 27 aa, synthetic construct
  REGION 1..27: note = Synthetic
KDWMKTAGEWLKKKGPGILKAAMAAAT

SEQ ID NO: 1596 - protein, 25 aa, synthetic construct
  REGION 1..25: note = Synthetic
SILRGLEKLAKMGIALTNCKATKKC

SEQ ID NO: 1597 - protein, 25 aa, synthetic construct
  REGION 1..25: note = Synthetic
SILRGLEKLAKMGIALTNCKATKKC

SEQ ID NO: 1598 - protein, 31 aa, synthetic construct
  REGION 1..31: note = Synthetic
DEWAEKLRSWLRSWQERNVTVYNSICNRRGK

SEQ ID NO: 1599 - protein, 15 aa, synthetic construct
  REGION 1..15: note = Synthetic
CKTACSDLCQDVDDA

SEQ ID NO: 1600 - protein, 27 aa, synthetic construct
  REGION 1..27: note = Synthetic
KLFRVYSNFLRGKLKLYTGEACRRGDR

SEQ ID NO: 1601 - protein, 27 aa, synthetic construct
  REGION 1..27: note = Synthetic
LTTLKDFLESLKSILRGKYLQSCTSMS

SEQ ID NO: 1602 - protein, 27 aa, synthetic construct
  REGION 1..27: note = Synthetic
LTTLKDFLESLKSILRGKYLQSCTSMS

SEQ ID NO: 1603 - protein, 11 aa, synthetic construct
  REGION 1..11: note = Synthetic
INAVSALAKHF

SEQ ID NO: 1604 - protein, 25 aa, synthetic construct
  REGION 1..25: note = Synthetic
FKKAGTDLLNFLSSFIDPKKQPATR

SEQ ID NO: 1605 - protein, 14 aa, synthetic construct
  REGION 1..14: note = Synthetic
YSRGCSAITRCRRS

SEQ ID NO: 1606 - protein, 22 aa, synthetic construct
  REGION 1..22: note = Synthetic
NAILNGLGKGMNFIENTFSFCV

SEQ ID NO: 1607 - protein, 28 aa, synthetic construct
  REGION 1..28: note = Synthetic
EWIQRMMEVLRKRSSSTLPVPVFKRKIP

SEQ ID NO: 1608 - protein, 12 aa, synthetic construct
  REGION 1..12: note = Synthetic
AIAGLVHGLINR

SEQ ID NO: 1609 - protein, 21 aa, synthetic construct
  REGION 1..21: note = Synthetic
STLRDLLERLKTIMKEKYSKC

SEQ ID NO: 1610 - protein, 33 aa, synthetic construct
  REGION 1..33: note = Synthetic
FKELERAGQRVRDAIISAGPAVATVAQATALAK

SEQ ID NO: 1611 - protein, 17 aa, synthetic construct
  REGION 1..17: note = Synthetic
DLLERLKTIMKEKYSKC

SEQ ID NO: 1612 - protein, 21 aa, synthetic construct
  REGION 1..21: note = Synthetic
STLRDLLERLKTIMKEKYSKC

SEQ ID NO: 1613 - protein, 12 aa, synthetic construct
  REGION 1..12: note = Synthetic
KCINRMCKCYGC

SEQ ID NO: 1614 - protein, 34 aa, synthetic construct
  REGION 1..34: note = Synthetic
FKELERAGQRVRDAVISAAPAVATVGQAAAIARG

SEQ ID NO: 1615 - protein, 34 aa, synthetic construct
  REGION 1..34: note = Synthetic
FKELERAGQRVRDAVISAAAVATVGQAAAIARGG

SEQ ID NO: 1616 - protein, 20 aa, synthetic construct
  REGION 1..20: note = Synthetic
MLKDFLERLKTIMKEKYSKC

SEQ ID NO: 1617 - protein, 29 aa, synthetic construct
  REGION 1..29: note = Synthetic
LWKSLLKGAGQLVGGVVQHFMGSQGQPES

SEQ ID NO: 1618 - protein, 19 aa, synthetic construct
  REGION 1..19: note = Synthetic
EKAAGKAKKFGGKIKKWFG

SEQ ID NO: 1619 - protein, 19 aa, synthetic construct
  REGION 1..19: note = Synthetic
EKAAGKAKKFGGKIKKWFG

SEQ ID NO: 1620 - protein, 31 aa, synthetic construct
  REGION 1..31: note = Synthetic
CYDCGKACFRRGKNLARCQKFVCRCTISKLR

SEQ ID NO: 1621 - protein, 26 aa, synthetic construct
  REGION 1..26: note = Synthetic
IPAYYKRCARLLTRLAVSPVCMEDKQ

SEQ ID NO: 1622 - protein, 33 aa, synthetic construct
  REGION 1..33: note = Synthetic
QIADLFDSGLSDADDLFDSGLSDADAKFMKMFM

SEQ ID NO: 1623 - protein, 11 aa, synthetic construct
  REGION 1..11: note = Synthetic
SAITHCYRYAR

SEQ ID NO: 1624 - protein, 25 aa, synthetic construct
  REGION 1..25: note = Synthetic
VKKAGTDLINFLNNFMDLKAQPATQ

SEQ ID NO: 1625 - protein, 23 aa, synthetic construct
  REGION 1..23: note = Synthetic
VLSNVIGYLKKLGTGALNAVLKQ

SEQ ID NO: 1626 - protein, 24 aa, synthetic construct
  REGION 1..24: note = Synthetic
LVASIGRALGGLLADVVKSKEQPA

SEQ ID NO: 1627 - protein, 12 aa, synthetic construct
  REGION 1..12: note = Synthetic
KCINRVCKCYGC

SEQ ID NO: 1628 - protein, 34 aa, synthetic construct
  REGION 1..34: note = Synthetic
FGKRGLRNLDNLDDDIFEPEMSEADLRYLQDLLR

SEQ ID NO: 1629 - protein, 32 aa, synthetic construct
  REGION 1..32: note = Synthetic
LLDKLKNFAKTAGKGVLQSLLNTASCKLSGQC

SEQ ID NO: 1630 - protein, 32 aa, synthetic construct; identical to SEQ ID NO: 1629
  REGION 1..32: note = Synthetic

SEQ ID NO: 1631 - protein, 32 aa, synthetic construct; identical to SEQ ID NO: 1629
  REGION 1..32: note = Synthetic

SEQ ID NO: 1632 - protein, 19 aa, synthetic construct
  REGION 1..19: note = Synthetic
LKDFLERLKTIMKEKYSKC

SEQ ID NO: 1633 - protein, 23 aa, synthetic construct
  REGION 1..23: note = Synthetic
KAARKAAKAAKKAAKAAKASAAA

SEQ ID NO: 1634 - protein, 32 aa, synthetic construct
  REGION 1..32: note = Synthetic
GILSSIKGVAKGVAKNVAAQLLDTLKCKITGC

SEQ ID NO: 1635 - protein, 22 aa, synthetic construct
  REGION 1..22: note = Synthetic
NAILNGLGKGMNFIENTFSFCV

SEQ ID NO: 1636 - protein, 22 aa, synthetic construct
  REGION 1..22: note = Synthetic
NAILNGLGKGMNFIENTFSFCV

SEQ ID NO: 1637 - protein, 37 aa, synthetic construct
  REGION 1..37: note = Synthetic
RKAVSELKKVMNDLLPHSTLRKRKRSQSSIRGRRASK

SEQ ID NO: 1638 - protein, 22 aa, synthetic construct
  REGION 1..22: note = Synthetic
NAILNRLGKGMNFIENTFSFCV

SEQ ID NO: 1639 - protein, 21 aa, synthetic construct
  REGION 1..21: note = Synthetic
STLKDLLEGLKTIMKEKYSKC

SEQ ID NO: 1640 - protein, 14 aa, synthetic construct
  REGION 1..14: note = Synthetic
DKLKEFGNTLEDKA

SEQ ID NO: 1641 - protein, 13 aa, synthetic construct
  REGION 1..13: note = Synthetic
KIVQKMLKSGIRK

SEQ ID NO: 1642 - protein, 11 aa, synthetic construct
  REGION 1..11: note = Synthetic
NAVSAIAKHFG

SEQ ID NO: 1643 - protein, 11 aa, synthetic construct
  REGION 1..11: note = Synthetic
NAVSAIAKHFG

SEQ ID NO: 1644 - protein, 11 aa, synthetic construct
  REGION 1..11: note = Synthetic
NAVSAIAKHFG

SEQ ID NO: 1645 - protein, 19 aa, synthetic construct
  REGION 1..19: note = Synthetic
SDFVQGMKKAAEDMKNKVI

SEQ ID NO: 1646 - protein, 34 aa, synthetic construct
  REGION 1..34: note = Synthetic
SFLEQADRLMKNLQEINLVDRNSKLSLRLKRLTK

SEQ ID NO: 1647 - protein, 31 aa, synthetic construct
  REGION 1..31: note = Synthetic
DALSKLFRIYSNFLRGKLTLYTGEACRRGDR

SEQ ID NO: 1648 - protein, 31 aa, synthetic construct; identical to SEQ ID NO: 1647
  REGION 1..31: note = Synthetic

SEQ ID NO: 1649 - protein, 31 aa, synthetic construct; identical to SEQ ID NO: 1647
  REGION 1..31: note = Synthetic

SEQ ID NO: 1650 - protein, 23 aa, synthetic construct
  REGION 1..23: note = Synthetic
STLENFLERLKTIMREKYSKCSS

SEQ ID NO: 1651 - protein, 23 aa, synthetic construct
  REGION 1..23: note = Synthetic
STLENFLERLKTIMREKYSKCSS

SEQ ID NO: 1652 - protein, 23 aa, synthetic construct
  REGION 1..23: note = Synthetic
STLENFLERLKTIMREKYSKCSS

SEQ ID NO: 1653 - protein, 23 aa, synthetic construct
  REGION 1..23: note = Synthetic
STLENFLERLKTIMREKYSKCSS

SEQ ID NO: 1654 - protein, 23 aa, synthetic construct
  REGION 1..23: note = Synthetic
STLENFLERLKTIMREKYSKCSS

SEQ ID NO: 1655 - protein, 23 aa, synthetic construct
  REGION 1..23: note = Synthetic
STLENFLERLKTIMREKYSKCSS

SEQ ID NO: 1656 - protein, 25 aa, synthetic construct
  REGION 1..25: note = Synthetic
SILKGLEKLAKMGIALTNCKATKKC

SEQ ID NO: 1657 - protein, 23 aa, synthetic construct
  REGION 1..23: note = Synthetic
STLEDFLERLKTIMREKYSKCSS

SEQ ID NO: 1658 - protein, 23 aa, synthetic construct
  REGION 1..23: note = Synthetic
STLEDFLERLKTIMREKYSKCSS

SEQ ID NO: 1659 - protein, 29 aa, synthetic construct
  REGION 1..29: note = Synthetic
KAKSALKDVLKKAKDKVKEKVAQHFLKQL

SEQ ID NO: 1660 - protein, 34 aa, synthetic construct
  REGION 1..34: note = Synthetic
VRKIYQTAKHLPNVCDIPQVDVCPFNIPSFPSFY

SEQ ID NO: 1661 - protein, 17 aa, synthetic construct
  REGION 1..17: note = Synthetic
TTFIEKLTTFIRKASKT

SEQ ID NO: 1662 - protein, 22 aa, synthetic construct
  REGION 1..22: note = Synthetic
KWVQDAMKYLDENSRTTKYSSF

SEQ ID NO: 1663 - protein, 29 aa, synthetic construct
  REGION 1..29: note = Synthetic
RGIMDTVKGVAKTVAASLLDKLKCKITGC

SEQ ID NO: 1664 - protein, 12 aa, synthetic construct
  REGION 1..12: note = Synthetic
DLASGIVEAIKS

SEQ ID NO: 1665 - protein, 16 aa, synthetic construct
  REGION 1..16: note = Synthetic
YRRGCSVITHCYRQTS

SEQ ID NO: 1666 - protein, 42 aa, synthetic construct
  REGION 1..42: note = Synthetic
CFKKFPKGITRLPWVIRGCAATCPKAEARVYVDCCARDKCNR

SEQ ID NO: 1667 - protein, 35 aa, synthetic construct
  REGION 1..35: note = Synthetic
NLLKMLSKAVDALKSDKKVRTIIIRSEVPGIFCAE

SEQ ID NO: 1668 - protein, 13 aa, synthetic construct
  REGION 1..13: note = Synthetic
KWVREYINSLEMS

SEQ ID NO: 1669 - protein, 13 aa, synthetic construct
  REGION 1..13: note = Synthetic
DFAKHVIGIASKL

SEQ ID NO: 1670 - protein, 19 aa, synthetic construct
  REGION 1..19: note = Synthetic
EKAAGKAKKFGGKIKKWFG

SEQ ID NO: 1671 - protein, 25 aa, synthetic construct
  REGION 1..25: note = Synthetic
EQFQNCLSKICTDVQKTLGISESVK

SEQ ID NO: 1672 - protein, 18 aa, synthetic construct
  REGION 1..18: note = Synthetic
KGVPKFAKGLFGMLPFFK

SEQ ID NO: 1673 - protein, 15 aa, synthetic construct
  REGION 1..15: note = Synthetic
DMWEDVYELMQNWQR

SEQ ID NO: 1674 - protein, 22 aa, synthetic construct
  REGION 1..22: note = Synthetic
EVAHFITKLLSYTKQLFRHGPF

SEQ ID NO: 1675 - protein, 21 aa, synthetic construct
  REGION 1..21: note = Synthetic
ATRFMEKLMTFVRKASKKTRL

SEQ ID NO: 1676 - protein, 11 aa, synthetic construct
  REGION 1..11: note = Synthetic
INAVSAIAKHF

SEQ ID NO: 1677 - protein, 20 aa, synthetic construct
  REGION 1..20: note = Synthetic
YNRGCSVITRCARDTNDIKT

SEQ ID NO: 1678 - protein, 13 aa, synthetic construct
  REGION 1..13: note = Synthetic
GRDVSQWIRGCRV

SEQ ID NO: 1679 - protein, 19 aa, synthetic construct
  REGION 1..19: note = Synthetic
SIVRHFVTEVRDMFFYFIL

SEQ ID NO: 1680 - protein, 28 aa, synthetic construct
  REGION 1..28: note = Synthetic
LWSKIKEAGKAAVKAAGKAALGAVADSV

SEQ ID NO: 1681 - protein, 16 aa, synthetic construct
  REGION 1..16: note = Synthetic
RLQKIIQKLLKSDKSS

SEQ ID NO: 1682 - protein, 19 aa, synthetic construct
  REGION 1..19: note = Synthetic
EKAAGKAKKFGGKIRKWFG

SEQ ID NO: 1683 - protein, 18 aa, synthetic construct
  REGION 1..18: note = Synthetic
FAGLLASILKPIIDAAKG

SEQ ID NO: 1684 - protein, 27 aa, synthetic construct
  REGION 1..27: note = Synthetic
KLFRIYSNFLRGKLKLYTGEACRRGDR

SEQ ID NO: 1685 - protein, 19 aa, synthetic construct
  REGION 1..19: note = Synthetic
EKAADKAKKFGGKIKKWFG

SEQ ID NO: 1686 - protein, 29 aa, synthetic construct
  REGION 1..29: note = Synthetic
FLDTLKGAAKDVAGKLEGLKCKITGCKLP

SEQ ID NO: 1687 - protein, 19 aa, synthetic construct
  REGION 1..19: note = Synthetic
EKAAGKAKKFGGKIKKWFG

SEQ ID NO: 1688 - protein, 19 aa, synthetic construct
  REGION 1..19: note = Synthetic
EKAAGKAKKFGGKIKKWFG

SEQ ID NO: 1689 - protein, 19 aa, synthetic construct
  REGION 1..19: note = Synthetic
EKAAGKAKKFGGKIKKWFG

SEQ ID NO: 1690 - protein, 19 aa, synthetic construct
  REGION 1..19: note = Synthetic
EKAAGKAKKFGGKIKKWFG

SEQ ID NO: 1691 - protein, 19 aa, synthetic construct
  REGION 1..19: note = Synthetic
EKAAGKAKKFGGKIKKWFG

SEQ ID NO: 1692 - protein, 19 aa, synthetic construct
  REGION 1..19: note = Synthetic
EKAAGKAKKFGGKIKKWFG

SEQ ID NO: 1693 - protein, 19 aa, synthetic construct
  REGION 1..19: note = Synthetic
EKAAGKAKKFGGKIKKWFG

SEQ ID NO: 1694 - protein, 35 aa, synthetic construct
  REGION 1..35: note = Synthetic
MWSKIKNAGKAAAKASKKAAGKAALGAVSEALGEQ

SEQ ID NO: 1695 - protein, 16 aa, synthetic construct
  REGION 1..16: note = Synthetic
LKKVIQKILDGGNKEN

SEQ ID NO: 1696 - protein, 19 aa, synthetic construct
  REGION 1..19: note = Synthetic
SELIKELEDILEEIKMLKP

SEQ ID NO: 1697 - protein, 20 aa, synthetic construct
  REGION 1..20: note = Synthetic
RHITRLVSNCLDLATAIRQP

SEQ ID NO: 1698 - protein, 13 aa, synthetic construct
  REGION 1..13: note = Synthetic
DLAKHVIGIASKL

SEQ ID NO: 1699 - protein, 22 aa, synthetic construct
  REGION 1..22: note = Synthetic
LWQKIKNAAGDLASGIVEGIKS

SEQ ID NO: 1700 - protein, 13 aa, synthetic construct
  REGION 1..13: note = Synthetic
IVSGAVSLAKKLG

SEQ ID NO: 1701 - protein, 11 aa, synthetic construct
  REGION 1..11: note = Synthetic
NAVSALAKHFG

SEQ ID NO: 1702 - protein, 11 aa, synthetic construct
  REGION 1..11: note = Synthetic
NAVSALAKHFG

SEQ ID NO: 1703 - protein, 23 aa, synthetic construct
  REGION 1..23: note = Synthetic
EVIQLVKNLLTYARSVFRHGNFP

SEQ ID NO: 1704 - protein, 33 aa, synthetic construct
  REGION 1..33: note = Synthetic
FGKRGLSDLDDLDESFDGEVSQADIDFLKELMQ

SEQ ID NO: 1705 - protein, 17 aa, synthetic construct
  REGION 1..17: note = Synthetic
KFLQIFTDFLDNLSETL

SEQ ID NO: 1706 - protein, 16 aa, synthetic construct
  REGION 1..16: note = Synthetic
KCCGGCPRLCEKPCYD

SEQ ID NO: 1707 - protein, 12 aa, synthetic construct
  REGION 1..12: note = Synthetic
DLASGIVEGIKS

SEQ ID NO: 1708 - protein, 36 aa, synthetic construct
  REGION 1..36: note = Synthetic
IFSLVKGVAKLAGKTLAKEGGKFGLELAMCKIAKQC

SEQ ID NO: 1709 - protein, 36 aa, synthetic construct
  REGION 1..36: note = Synthetic
IFSLIKGAAQLIGKTVAKEAGKTGLELMACKVTKQC

SEQ ID NO: 1710 - protein, 19 aa, synthetic construct
  REGION 1..19: note = Synthetic
QECVQQLESLLQKAISRLA

SEQ ID NO: 1711 - protein, 28 aa, synthetic construct
  REGION 1..28: note = Synthetic
DCYRRFEQGVAKGIQCWCIGKDVTYKGV

SEQ ID NO: 1712 - protein, 35 aa, synthetic construct
  REGION 1..35: note = Synthetic
KVQKCVYQCFEKIDKRVRTKYMTTINVNKLIVDYD

SEQ ID NO: 1713 - protein, 25 aa, synthetic construct
  REGION 1..25: note = Synthetic
NWRKILGQIASVGAGLLGSLLAGYE

SEQ ID NO: 1714 - protein, 12 aa, synthetic construct
  REGION 1..12: note = Synthetic
LFDIIKNIFSGL

SEQ ID NO: 1715 - protein, 28 aa, synthetic construct
  REGION 1..28: note = Synthetic
SQCWTPCKKAIGSLQSKCMNGKCKCYNG

SEQ ID NO: 1716 - protein, 41 aa, synthetic construct
  REGION 1..41: note = Synthetic
LHWVQKLMKNIEARRKKVSPGVRAMSTKALVQRYPANSTSI

SEQ ID NO: 1717 - protein, 20 aa, synthetic construct
  REGION 1..20: note = Synthetic
FRFFYNILKSINTLFTASKN

SEQ ID NO: 1718 - protein, 15 aa, synthetic construct
  REGION 1..15: note = Synthetic
VQKIIQKILNKGKAN

SEQ ID NO: 1719 - protein, 40 aa, synthetic construct
  REGION 1..40: note = Synthetic
YIKAAWKIGRHALGDMTDEEFQDFMKEVEQAREEELQSRQ

SEQ ID NO: 1720 - protein, 33 aa, synthetic construct
  REGION 1..33: note = Synthetic
FSSLFKAGAKYLLKSVGKAGAQQLACKAANNCA

SEQ ID NO: 1721 - protein, 24 aa, synthetic construct
  REGION 1..24: note = Synthetic
LDRICEDCYNLFREPQLHMLCKYV

SEQ ID NO: 1722 - protein, 31 aa, synthetic construct
  REGION 1..31: note = Synthetic
DKLKEFGNTLEDKAREVINRIKQSELSAKTR

SEQ ID NO: 1723 - protein, 15 aa, synthetic construct
  REGION 1..15: note = Synthetic
YCRFGNTIYRLCCRR

SEQ ID NO: 1724 - protein, 27 aa, synthetic construct
  REGION 1..27: note = Synthetic
KLFRVYSNFLRGKLKLYTGEACRRGDR

SEQ ID NO: 1725 - protein, 27 aa, synthetic construct
  REGION 1..27: note = Synthetic
IMDSVKGLAKNLAGKLLDSLKCKITGC

SEQ ID NO: 1726 - protein, 19 aa, synthetic construct
  REGION 1..19: note = Synthetic
WMSKIASGIGTFLSGMQQG

SEQ ID NO: 1727 - protein, 21 aa, synthetic construct
  REGION 1..21: note = Synthetic
STLKDFLERLKTIMKEKYSKC

SEQ ID NO: 1728 - protein, 24 aa, synthetic construct
  REGION 1..24: note = Synthetic
VVDILKGAAKDLAGHLASKVMNKI

SEQ ID NO: 1729 - protein, 19 aa, synthetic construct
  REGION 1..19: note = Synthetic
REFVQQLESLLQKVAGYYE

SEQ ID NO: 1730 - protein, 17 aa, synthetic construct
  REGION 1..17: note = Synthetic
KELNQMANNCMTLANMI

SEQ ID NO: 1731 - protein, 29 aa, synthetic construct
  REGION 1..29: note = Synthetic
LTTILESFWEWFNESDDYKNPCCCSSCPF

SEQ ID NO: 1732 - protein, 31 aa, synthetic construct
  REGION 1..31: note = Synthetic
CEKITRCARDAARYTESFNVDDDESPIINLH

SEQ ID NO: 1733 - protein, 35 aa, synthetic construct
  REGION 1..35: note = Synthetic
GLFRFARGYVEARTKWINLKNGDATVEYSCYVLHY

SEQ ID NO: 1734 - protein, 22 aa, synthetic construct
  REGION 1..22: note = Synthetic
RQLRSFMQDVFRSLRCISVSQC

SEQ ID NO: 1735 - protein, 22 aa, synthetic construct
  REGION 1..22: note = Synthetic
RQFLDYLQEFLGVMSTEWTMEG

SEQ ID NO: 1736 - protein, 17 aa, synthetic construct
  REGION 1..17: note = Synthetic
KELNQMANNCMTLANMI

SEQ ID NO: 1737 - protein, 27 aa, synthetic construct
  REGION 1..27: note = Synthetic
KLFRIYSNFLRGKLKLYTGEACRRGDR

SEQ ID NO: 1738 - protein, 27 aa, synthetic construct
  REGION 1..27: note = Synthetic
KLFRIYSNFLRGKLKLYTGEACRRGDR

SEQ ID NO: 1739 - protein, 27 aa, synthetic construct
  REGION 1..27: note = Synthetic
KLFRIYSNFLRGKLKLYTGEACRRGDR

SEQ ID NO: 1740 - protein, 15 aa, synthetic construct
  REGION 1..15: note = Synthetic
SLFGALSNIGRNRNQ

SEQ ID NO: 1741 - protein, 21 aa, synthetic construct
  REGION 1..21: note = Synthetic
LEDFLDRLKTAMQEKYSKRQS

SEQ ID NO: 1742 - protein, 33 aa, synthetic construct
  REGION 1..33: note = Synthetic
GLFDVVKGVLKGAGKNVAGSLLEQLKCKLSGGC

SEQ ID NO: 1743 - protein, 19 aa, synthetic construct
  REGION 1..19: note = Synthetic
LVEQMVEKIRSIWNGKLGY

SEQ ID NO: 1744 - protein, 17 aa, synthetic construct
  REGION 1..17: note = Synthetic
FNNIFNSIYSFFKNAVQ

SEQ ID NO: 1745 - protein, 25 aa, synthetic construct
  REGION 1..25: note = Synthetic
NCLSTMRSMMTNLTKTMDNIIIIAL

SEQ ID NO: 1746 - protein, 18 aa, synthetic construct
  REGION 1..18: note = Synthetic
VKQVLNQLLKNMDHLKTC

SEQ ID NO: 1747 - protein, 20 aa, synthetic construct
  REGION 1..20: note = Synthetic
ILSAGKSIIKGLANGLAEHF

SEQ ID NO: 1748 - protein, 21 aa, synthetic construct
  REGION 1..21: note = Synthetic
LEDFLDRLKTAMQEKYSKRQS

SEQ ID NO: 1749 - protein, 21 aa, synthetic construct
  REGION 1..21: note = Synthetic
LEDFLDRLKTAMQEKYSKRQS

SEQ ID NO: 1750 - protein, 21 aa, synthetic construct
  REGION 1..21: note = Synthetic
LEDFLDRLKTAMQEKYSKRQS

SEQ ID NO: 1751 - protein, 15 aa, synthetic construct
  REGION 1..15: note = Synthetic
IKTLASNALSLISDL

SEQ ID NO: 1752 - protein, 19 aa, synthetic construct
  REGION 1..19: note = Synthetic
LGGLMKAFPAIICAVTKKC

SEQ ID NO: 1753 - protein, 12 aa, synthetic construct
  REGION 1..12: note = Synthetic
KRCHNYAKKCVT

SEQ ID NO: 1754 - protein, 15 aa, synthetic construct
  REGION 1..15: note = Synthetic
FFKKLWRGVKKVVKK

SEQ ID NO: 1755 - protein, 22 aa, synthetic construct
  REGION 1..22: note = Synthetic
AYYKRCARLLTRLAVSPLCSQT

SEQ ID NO: 1756 - protein, 17 aa, synthetic construct
  REGION 1..17: note = Synthetic
FLNRWITFCQSIISTLT

SEQ ID NO: 1757 - protein, 17 aa, synthetic construct
  REGION 1..17: note = Synthetic
FLNRWITFCQSIISTLT

SEQ ID NO: 1758 - protein, 17 aa, synthetic construct
  REGION 1..17: note = Synthetic
FLNRWITFCQSIISTLT

SEQ ID NO: 1759 - protein, 17 aa, synthetic construct
  REGION 1..17: note = Synthetic
FLNRWITFCQSIISTLT

SEQ ID NO: 1760 - protein, 17 aa, synthetic construct
  REGION 1..17: note = Synthetic
FLNRWITFCQSIISTLT

SEQ ID NO: 1761 - protein, 17 aa, synthetic construct
  REGION 1..17: note = Synthetic
FLNRWITFCQSIISTLT

SEQ ID NO: 1762 - protein, 17 aa, synthetic construct
  REGION 1..17: note = Synthetic
FLNRWITFCQSIISTLT

SEQ ID NO: 1763 - protein, 17 aa, synthetic construct
  REGION 1..17: note = Synthetic
FLNRWITFCQSIISTLT

SEQ ID NO: 1764 - protein, 17 aa, synthetic construct
  REGION 1..17: note = Synthetic
FLNRWITFCQSIISTLT

SEQ ID NO: 1765 - protein, 17 aa, synthetic construct
  REGION 1..17: note = Synthetic
FLNRWITFCQSIISTLT

SEQ ID NO: 1766 - protein, 17 aa, synthetic construct
  REGION 1..17: note = Synthetic
FLNRWITFCQSIISTLT

SEQ ID NO: 1767 - protein, 17 aa, synthetic construct
  REGION 1..17: note = Synthetic
FLNRWITFCQSIISTLT

SEQ ID NO: 1768 - protein, 17 aa, synthetic construct
  REGION 1..17: note = Synthetic
FLNRWITFCQSIISTLT

SEQ ID NO: 1769 - protein, 28 aa, synthetic construct
  REGION 1..28: note = Synthetic
NCYRRFEQGVAKGIQCWCIEKDVTYKGV

SEQ ID NO: 1770 - protein, 22 aa, synthetic construct
  REGION 1..22: note = Synthetic
NAILNGLGKGMNFIENTFSFCV

SEQ ID NO: 1771 - protein, 22 aa, synthetic construct
  REGION 1..22: note = Synthetic
NAILNGLGKGMNFIENTFSFCV

SEQ ID NO: 1772 - protein, 17 aa, synthetic construct
  REGION 1..17: note = Synthetic
FLNKWITFCQSIFSTLT

SEQ ID NO: 1773 - protein, 17 aa, synthetic construct
  REGION 1..17: note = Synthetic
QVKKVVQKALKRVEKQN

SEQ ID NO: 1774 - protein, 41 aa, synthetic construct
  REGION 1..41: note = Synthetic
LKQILHSWGEECRACAEKTDYVNLIQELAPKYAATHPKTEL

SEQ ID NO: 1775 - protein, 34 aa, synthetic construct
  REGION 1..34: note = Synthetic
RLYSFLQNCFTNIKYKYKEYTNINLCRLSIYISK

SEQ ID NO: 1776 - protein, 27 aa, synthetic construct
  REGION 1..27: note = Synthetic
TDCTTCIQDAAKKIREVCPNQSDARIL

SEQ ID NO: 1777 - protein, 28 aa, synthetic construct
  REGION 1..28: note = Synthetic
VRGMASKAGAIAGKIAKVALKALGRRDS

SEQ ID NO: 1778 - protein, 28 aa, synthetic construct
  REGION 1..28: note = Synthetic
VRGMASKAGAIAGKIAKVALKALGRRDS

SEQ ID NO: 1779 - protein, 41 aa, synthetic construct
  REGION 1..41: note = Synthetic
LKSVANTIPGINDDFAKQLPAKCGVNIGVPFSKTVDCNSIN

SEQ ID NO: 1780 - protein, 12 aa, synthetic construct
  REGION 1..12: note = Synthetic
HCIKSIGRCVAH

SEQ ID NO: 1781 - protein, 36 aa, synthetic construct
  REGION 1..36: note = Synthetic
ILSLVKGVAKLAGKGLAKEGGKFGLELIACKIAKQC

SEQ ID NO: 1782 - protein, 19 aa, synthetic construct
  REGION 1..19: note = Synthetic
LGGLMKAFPALICAVTKKC

SEQ ID NO: 1783 - protein, 24 aa, synthetic construct
  REGION 1..24: note = Synthetic
GRKLYNQIRRWPEWLENVDSIKNA

SEQ ID NO: 1784 - protein, 25 aa, synthetic construct
  REGION 1..25: note = Synthetic
KTIKNLLKAINKQRTKRSPRTRKEA

SEQ ID NO: 1785 - protein, 33 aa, synthetic construct
  REGION 1..33: note = Synthetic
LWKDVLKKIGTVALHAGKAAFGAAADTISQGGS

SEQ ID NO: 1786 - protein, 30 aa, synthetic construct
  REGION 1..30: note = Synthetic
LWKDVLKKIGTVALHAGKAALGAVADTISQ

SEQ ID NO: 1787 - protein, 17 aa, synthetic construct
  REGION 1..17: note = Synthetic
KELSQMANNCMTLANMI

SEQ ID NO: 1788 - protein, 16 aa, synthetic construct
  REGION 1..16: note = Synthetic
FCKRFAGGAKKCHCYC

SEQ ID NO: 1789 - protein, 29 aa, synthetic construct
  REGION 1..29: note = Synthetic
GLWETIKNFGKKFTLNILHKLKCKIGGGC

SEQ ID NO: 1790 - protein, 33 aa, synthetic construct
  REGION 1..33: note = Synthetic
SQLRNLIRSVRTVMRVPLIIVNSIAIVLLLLFG

SEQ ID NO: 1791 - protein, 25 aa, synthetic construct
  REGION 1..25: note = Synthetic
NMANKCRDCCGGGKKCFGPQCLCNR

SEQ ID NO: 1792 - protein, 14 aa, synthetic construct
  REGION 1..14: note = Synthetic
GVNAIENMLSFCFR

SEQ ID NO: 1793 - protein, 36 aa, synthetic construct
  REGION 1..36: note = Synthetic
LFSILRGAAKFASKGLGKDLTKLGVDLVACKISKQC

SEQ ID NO: 1794 - protein, 20 aa, synthetic construct
  REGION 1..20: note = Synthetic
LLGSIGNAIGAFIANKLKPK

SEQ ID NO: 1795 - protein, 23 aa, synthetic construct
  REGION 1..23: note = Synthetic
LENCGDACVNFCNGDAGLTSLTA

SEQ ID NO: 1796 - protein, 26 aa, synthetic construct
  REGION 1..26: note = Synthetic
GQCDKCCKKAGDRAGNCVYFKCKCNQ

SEQ ID NO: 1797 - protein, 13 aa, synthetic construct
  REGION 1..13: note = Synthetic
KWVREYINALELS

SEQ ID NO: 1798 - protein, 41 aa, synthetic construct
  REGION 1..41: note = Synthetic
TWARNCYNVCRLPGTISREICAKKCDCKIISGTTCPSDYPK

SEQ ID NO: 1799 - protein, 16 aa, synthetic construct
  REGION 1..16: note = Synthetic
KWVQRYIALLREQQQS

SEQ ID NO: 1800 - protein, 30 aa, synthetic construct
  REGION 1..30: note = Synthetic
KIMDPVKDLFSKMSRSRSSSYQSYRSSSNY

SEQ ID NO: 1801 - protein, 17 aa, synthetic construct
  REGION 1..17: note = Synthetic
LRRALEQFQEFLESNKK

SEQ ID NO: 1802 - protein, 21 aa, synthetic construct
  REGION 1..21: note = Synthetic
LEDFLDRLKTAMQEKYSKRQS

SEQ ID NO: 1803 - protein, 12 aa, synthetic construct
  REGION 1..12: note = Synthetic
FYGSYTGLGSSL

SEQ ID NO: 1804 - protein, 18 aa, synthetic construct
  REGION 1..18: note = Synthetic
LKWIQEYLEKALNKRLKM

SEQ ID NO: 1805 - protein, 16 aa, synthetic construct
  REGION 1..16: note = Synthetic
FGTWAKSISGLYCKCY

SEQ ID NO: 1806 - protein, 20 aa, synthetic construct
  REGION 1..20: note = Synthetic
YSRGCDTITRCARDTNDINT

SEQ ID NO: 1807 - protein, 42 aa, synthetic construct
  REGION 1..42: note = Synthetic
QVWNSVCATAIAVMAEIFAAMLVRMRGQAAARTPAAKAQKTQ

SEQ ID NO: 1808 - protein, 33 aa, synthetic construct
  REGION 1..33: note = Synthetic
MWKDVLKKIGTVALHAGKAALGAVADTISQGEQ

SEQ ID NO: 1809 - protein, 18 aa, synthetic construct
  REGION 1..18: note = Synthetic
LKWIQEYLEKALNKRFKM

SEQ ID NO: 1810 - protein, 18 aa, synthetic construct
  REGION 1..18: note = Synthetic
LKWIQEYLEKALNKRFKM

SEQ ID NO: 1811 - protein, 27 aa, synthetic construct
  REGION 1..27: note = Synthetic
QAFNELIRVVHQLLPESSLRKRKRSRC

SEQ ID NO: 1812 - protein, 16 aa, synthetic construct
  REGION 1..16: note = Synthetic
NHLENFVSTLTKLMEL

SEQ ID NO: 1813 - protein, 14 aa, synthetic construct
  REGION 1..14: note = Synthetic
DLLAHLVGKISEKV

SEQ ID NO: 1814 - protein, 19 aa, synthetic construct
  REGION 1..19: note = Synthetic
EKAAGEAKKFGGKIKKWFG

SEQ ID NO: 1815 - protein, 33 aa, synthetic construct
  REGION 1..33: note = Synthetic
IIKCINHVCQYVGNLPDFASQIPKSTKMPYKGE

SEQ ID NO: 1816 - protein, 18 aa, synthetic construct
  REGION 1..18: note = Synthetic
CSNFCSTLSDVCQESWSG

SEQ ID NO: 1817 - protein, 18 aa, synthetic construct
  REGION 1..18: note = Synthetic
YWIHMLRYVAKTFLEKWA

SEQ ID NO: 1818 - protein, 22 aa, synthetic construct
  REGION 1..22: note = Synthetic
RQFLDYLQEFLGVMSTEWAMEG

SEQ ID NO: 1819 - protein, 33 aa, synthetic construct
  REGION 1..33: note = Synthetic
GLLSAVKGVLKGAGKNVAGSLMDKLKCKLFGGC

SEQ ID NO: 1820 - protein, 16 aa, synthetic construct
  REGION 1..16: note = Synthetic
IKKIVQKIMEDGGSAA

SEQ ID NO: 1821 - protein, 12 aa, synthetic construct
  REGION 1..12: note = Synthetic
LFDIIKNIVSTL

SEQ ID NO: 1822 - protein, 22 aa, synthetic construct
  REGION 1..22: note = Synthetic
NQFLDYLQEFLGVMNTEWIIES

SEQ ID NO: 1823 - protein, 25 aa, synthetic construct
  REGION 1..25: note = Synthetic
GLFKVLGSVAKHLLPHVAPIIAEKL

SEQ ID NO: 1824 - protein, 24 aa, synthetic construct
  REGION 1..24: note = Synthetic
GLFKVLGSVAKHLLPHVAPVIAEK

SEQ ID NO: 1825 - protein, 24 aa, synthetic construct
  REGION 1..24: note = Synthetic
GLFKVLGSVAKHLLPHVAPVIAEK

SEQ ID NO: 1826 - protein, 18 aa, synthetic construct
  REGION 1..18: note = Synthetic
CSNFCSTMSDVCQENWSG

SEQ ID NO: 1827 - protein, 14 aa, synthetic construct
  REGION 1..14: note = Synthetic
HYGKKALQKVSEKL

SEQ ID NO: 1828 - protein, 27 aa, synthetic construct
  REGION 1..27: note = Synthetic
QAFNELIRVVHQLLPESSLRKRKRSRC

SEQ ID NO: 1829 - protein, 27 aa, synthetic construct
  REGION 1..27: note = Synthetic
QAFNELIRVVHQLLPESSLRKRKRSRC

SEQ ID NO: 1830 - protein, 19 aa, synthetic construct
  REGION 1..19: note = Synthetic
LPGFIGKICRKICMMQQTH

SEQ ID NO: 1831 - protein, 13 aa, synthetic construct
  REGION 1..13: note = Synthetic
ERLKKMGGNLNSP

SEQ ID NO: 1832 - protein, 27 aa, synthetic construct
  REGION 1..27: note = Synthetic
CEGAVSQCTNACSNFCTKGSAKVVETA

SEQ ID NO: 1833 - protein, 22 aa, synthetic construct
  REGION 1..22: note = Synthetic
MSAIVKVVSNIIRPLVLKNFII

SEQ ID NO: 1834 - protein, 16 aa, synthetic construct
  REGION 1..16: note = Synthetic
LQAFLAKMKEIAAQTL

SEQ ID NO: 1835 - protein, 26 aa, synthetic construct
  REGION 1..26: note = Synthetic
EKLKTFYQKLVEKAEDLKGDLKAKLS

SEQ ID NO: 1836 - protein, 19 aa, synthetic construct
  REGION 1..19: note = Synthetic
GFKDLLKGAAKALVKTVLF

SEQ ID NO: 1837 - protein, 28 aa, synthetic construct
  REGION 1..28: note = Synthetic
DCYRRFEQGVAKGIQCWCIEKDVTYKGV

SEQ ID NO: 1838 - protein, 25 aa, synthetic construct
  REGION 1..25: note = Synthetic
WLGSALKIGAKLLPSVVGLFKKKKQ

SEQ ID NO: 1839 - protein, 25 aa, synthetic construct
  REGION 1..25: note = Synthetic
WLGSALKIGAKLLPSVVGLFQKKKK

SEQ ID NO: 1840 - protein, 15 aa, synthetic construct
  REGION 1..15: note = Synthetic
VKKIIDKMLNQASSN

SEQ ID NO: 1841 - protein, 19 aa, synthetic construct
  REGION 1..19: note = Synthetic
FKTLLHNLWDLLKQSLGLP

SEQ ID NO: 1842 - protein, 20 aa, synthetic construct
  REGION 1..20: note = Synthetic
STVTKIFKSLNSFLNSNSVK

SEQ ID NO: 1843 - protein, 35 aa, synthetic construct
  REGION 1..35: note = Synthetic
GMFRFARGYVEARTKLFDMKTGDATVESNCYILHY

SEQ ID NO: 1844 - protein, 28 aa, synthetic construct
  REGION 1..28: note = Synthetic
DCYRRFEQGVAKGIQCWCIEKDVTYKGI

SEQ ID NO: 1845 - protein, 28 aa, synthetic construct
  REGION 1..28: note = Synthetic
DCYRRFEQGVAKGIQCWCIEKDVTYKGV

SEQ ID NO: 1846 - protein, 28 aa, synthetic construct
  REGION 1..28: note = Synthetic
DCYRRFEQGVAKGIQCWCIEKDVTYKGV

SEQ ID NO: 1847 - protein, 28 aa, synthetic construct
  REGION 1..28: note = Synthetic
DCYRRFEQGVAKGIQCWCIEKDVTYKGV

SEQ ID NO: 1848 - protein, 35 aa, synthetic construct
  REGION 1..35: note = Synthetic
CKRACRTCCTHCRRVPPGTDGYANQTTCGGALKCP

SEQ ID NO: 1849 - protein, 28 aa, synthetic construct
  REGION 1..28: note = Synthetic
EVMKEAVERCNNACSEVCTKGSYAVATA

SEQ ID NO: 1850 - protein, 19 aa, synthetic construct
  REGION 1..19: note = Synthetic
EKAAGKAKKFGGKIKKWFG

SEQ ID NO: 1851 - protein, 26 aa, synthetic construct
  REGION 1..26: note = Synthetic
RYLQAYLKVIGNYTCHLLFGTHKKTL

SEQ ID NO: 1852 - protein, 13 aa, synthetic construct
  REGION 1..13: note = Synthetic
CSNFCHTWANVCL

SEQ ID NO: 1853 - protein, 33 aa, synthetic construct
  REGION 1..33: note = Synthetic
GLFSVVTGVLKAVGKNVAGSLLEQLKCKISGGC

SEQ ID NO: 1854 - protein, 23 aa, synthetic construct
  REGION 1..23: note = Synthetic
NFLNDIGKRGLQWSRSEQPSAYY

SEQ ID NO: 1855 - protein, 41 aa, synthetic construct
  REGION 1..41: note = Synthetic
DVCRNFMRRYQSRVTQGLVAGETAQQICEDLRLCIPSTGPL

SEQ ID NO: 1856 - protein, 16 aa, synthetic construct
  REGION 1..16: note = Synthetic
QVLSWIEEIIRKAESN

SEQ ID NO: 1857 - protein, 24 aa, synthetic construct
  REGION 1..24: note = Synthetic
AIENIADFFTRVCNTHNPSSRQRP

SEQ ID NO: 1858 - protein, 31 aa, synthetic construct
  REGION 1..31: note = Synthetic
RVVRECAHSCEQCASTLCAHGAGHIFNDAPV

SEQ ID NO: 1859 - protein, 19 aa, synthetic construct
  REGION 1..19: note = Synthetic
GILDFAKTVVGGIRNALGI

SEQ ID NO: 1860 - protein, 25 aa, synthetic construct
  REGION 1..25: note = Synthetic
GVLDILKGAAKDLAGHVATKVINKI

SEQ ID NO: 1861 - protein, 42 aa, synthetic construct
  REGION 1..42: note = Synthetic
KAVEKVKRVFSELQERGVYKAMSEFDIFINYIETYMTTKMQK

SEQ ID NO: 1862 - protein, 35 aa, synthetic construct
  REGION 1..35: note = Synthetic
FKELEKVGQRVRDAVISAGPAVATVAQATALAKGK

SEQ ID NO: 1863 - protein, 28 aa, synthetic construct
  REGION 1..28: note = Synthetic
HKAVNELIRVIHQLSPESSLRKRKRSRC

SEQ ID NO: 1864 - protein, 32 aa, synthetic construct
  REGION 1..32: note = Synthetic
WRRVMHCFSYCWRPLPADYKCNRFTVPNPPPK

SEQ ID NO: 1865 - protein, 29 aa, synthetic construct
  REGION 1..29: note = Synthetic
FLDTLKGAAKDVAGKLLEGLKCKIAGCKP

SEQ ID NO: 1866 - protein, 29 aa, synthetic construct
  REGION 1..29: note = Synthetic
GLWETIKNFGKKFTLNILHNLKCKIGGGC

SEQ ID NO: 1867 - protein, 13 aa, synthetic construct
  REGION 1..13: note = Synthetic
MEKAAGKIKNLFG

SEQ ID NO: 1868 - protein, 15 aa, synthetic construct
  REGION 1..15: note = Synthetic
LGHAVGNVLGGLFKS

SEQ ID NO: 1869 - protein, 16 aa, synthetic construct
  REGION 1..16: note = Synthetic
IKKIVQKMLDSGKKKN

SEQ ID NO: 1870 - protein, 24 aa, synthetic construct
  REGION 1..24: note = Synthetic
LWDDLKAAAKKVVSSLASAAIEKL

SEQ ID NO: 1871 - protein, 40 aa, synthetic construct
  REGION 1..40: note = Synthetic
DHLKDLGSRARAWLRSSKDNLLNKAHSLCPQLLCRPSDQN

SEQ ID NO: 1872 - protein, 21 aa, synthetic construct
  REGION 1..21: note = Synthetic
HNAAKAGFKLIKPIEKLIMPK

SEQ ID NO: 1873 - protein, 12 aa, synthetic construct
  REGION 1..12: note = Synthetic
ANEVYKKCPGMP

SEQ ID NO: 1874 - protein, 25 aa, synthetic construct
  REGION 1..25: note = Synthetic
NMAKKCRDCCGGNGKCFGPQCLCNR

SEQ ID NO: 1875 - protein, 33 aa, synthetic construct
  REGION 1..33: note = Synthetic
KVMNYLVETMLKLFQTQFIHLILHPLTFIYSAR

SEQ ID NO: 1876 - protein, 25 aa, synthetic construct
  REGION 1..25: note = Synthetic
NMAKKCRDCCGGNGKCFGPQCLCNR

SEQ ID NO: 1877 - protein, 26 aa, synthetic construct
  REGION 1..26: note = Synthetic
NMAKKCRDCCGGNGKCFGYQCLCNRG

SEQ ID NO: 1878 - protein, 21 aa, synthetic construct
  REGION 1..21: note = Synthetic
VYQCMDRIPNLCQRRCTAAAR

SEQ ID NO: 1879 - protein, 21 aa, synthetic construct
  REGION 1..21: note = Synthetic
VYQCMDRIPNLCQRRCTAAAR

SEQ ID NO: 1880 - protein, 21 aa, synthetic construct
  REGION 1..21: note = Synthetic
VYQCMDRIPNLCQRRCTAAAR

SEQ ID NO: 1881 - protein, 42 aa, synthetic construct
  REGION 1..42: note = Synthetic
GEEAMKKYSQILSHFEKLEPQAAVVKALGELDILLQWMEETE

SEQ ID NO: 1882 - protein, 19 aa, synthetic construct
  REGION 1..19: note = Synthetic
LYRYLTRFLHRYPIYYIRY

SEQ ID NO: 1883 - protein, 19 aa, synthetic construct
  REGION 1..19: note = Synthetic
KWVQNAMEYLNQKSQTLKS

SEQ ID NO: 1884 - protein, 21 aa, synthetic construct
  REGION 1..21: note = Synthetic
SDFENYIRTVSTTISPLLLIP

SEQ ID NO: 1885 - protein, 27 aa, synthetic construct
  REGION 1..27: note = Synthetic
KECWSVCEKLYNTSRGKCMNKKCRCYS

SEQ ID NO: 1886 - protein, 20 aa, synthetic construct
  REGION 1..20: note = Synthetic
VQRCLSTLKQGPRSGNKVIA

SEQ ID NO: 1887 - protein, 30 aa, synthetic construct
  REGION 1..30: note = Synthetic
LTKLLDSMHDVVENLLSFCFQTFLDKSMSI

SEQ ID NO: 1888 - protein, 25 aa, synthetic construct
  REGION 1..25: note = Synthetic
ENIRRVFNDCRDIIQRMHLRQYELL

SEQ ID NO: 1889 - protein, 22 aa, synthetic construct
  REGION 1..22: note = Synthetic
ALNRLQAALQDMLRRLDLSPGC

SEQ ID NO: 1890 - protein, 27 aa, synthetic construct
  REGION 1..27: note = Synthetic
KLFRIYSNFLRGKLKLYTGEACRRGDR

SEQ ID NO: 1891 - protein, 22 aa, synthetic construct
  REGION 1..22: note = Synthetic
SAILNGLGKGMNFIENTFSFCV

SEQ ID NO: 1892 - protein, 30 aa, synthetic construct
  REGION 1..30: note = Synthetic
WNNAVDSVFTTIENVPSSVNTVANRLINNK

SEQ ID NO: 1893 - protein, 20 aa, synthetic construct
  REGION 1..20: note = Synthetic
CQNIQSLLNTIVKWLFIVHL

SEQ ID NO: 1894 - protein, 27 aa, synthetic construct
  REGION 1..27: note = Synthetic
KLFRVYSNFLRGKLKLYTGEACRRGDR

SEQ ID NO: 1895 - protein, 27 aa, synthetic construct
  REGION 1..27: note = Synthetic
KLFRVYSNFLRGKLKLYTGEACRRGDR

SEQ ID NO: 1896 - protein, 22 aa, synthetic construct
  REGION 1..22: note = Synthetic
LLKLAAKGVAKVIPHLIPSRQQ

SEQ ID NO: 1897 - protein, 17 aa, synthetic construct
  REGION 1..17: note = Synthetic
ARLSDILHNVNRRAGGV

SEQ ID NO: 1898 - protein, 23 aa, synthetic construct
  REGION 1..23: note = Synthetic
FLKNAFKVVDQVFQKKLRLYLLF

SEQ ID NO: 1899 - protein, 32 aa, synthetic construct
  REGION 1..32: note = Synthetic
GHICESFKSFCKDSGRNGVKLRANCKKTCGLC

SEQ ID NO: 1900 - protein, 19 aa, synthetic construct
  REGION 1..19: note = Synthetic
REFVQLLESLLQKAMTRLV

SEQ ID NO: 1901 - protein, 16 aa, synthetic construct
  REGION 1..16: note = Synthetic
LLDFLKAAGKGLVTNL

SEQ ID NO: 1902 - protein, 19 aa, synthetic construct
  REGION 1..19: note = Synthetic
LLGSIGNAIGAFIANKLKP

SEQ ID NO: 1903 - protein, 42 aa, synthetic construct
  REGION 1..42: note = Synthetic
KAVEQVKRAFSKLQDRGVYKAMSEFDIFINYIETYVTTKMQK

SEQ ID NO: 1904 - protein, 12 aa, synthetic construct
  REGION 1..12: note = Synthetic
WFDVVKHIASAV

SEQ ID NO: 1905 - protein, 20 aa, synthetic construct
  REGION 1..20: note = Synthetic
AKKALAKAKTVLKLLLNKDN

SEQ ID NO: 1906 - protein, 23 aa, synthetic construct
  REGION 1..23: note = Synthetic
VYQCMDRVPNFCQRRCNGAVAAH

SEQ ID NO: 1907 - protein, 21 aa, synthetic construct
  REGION 1..21: note = Synthetic
KAVEFLNKWITFCQSIYSTMT

SEQ ID NO: 1908 - protein, 27 aa, synthetic construct
  REGION 1..27: note = Synthetic
KAVLDCLKAAGSSLSKAAITAIYNKIT

SEQ ID NO: 1909 - protein, 27 aa, synthetic construct
  REGION 1..27: note = Synthetic
KLFRIYSNFLRGKLKLYTGEACRRGDR

SEQ ID NO: 1910 - protein, 19 aa, synthetic construct
  REGION 1..19: note = Synthetic
EKAAGKAKKFGGKVKKWFG

SEQ ID NO: 1911 - protein, 32 aa, synthetic construct
  REGION 1..32: note = Synthetic
INSFFEKATEFVKKNIVLSSGFVGGFLLGLAS

SEQ ID NO: 1912 - protein, 22 aa, synthetic construct
  REGION 1..22: note = Synthetic
AYYKRCARLLTRLAMSPLCMQS

SEQ ID NO: 1913 - protein, 33 aa, synthetic construct
  REGION 1..33: note = Synthetic
SQLTNLIRSVRTVMRVPLIIVNSVAIVLLLLFG

SEQ ID NO: 1914 - protein, 17 aa, synthetic construct
  REGION 1..17: note = Synthetic
REIANLVDSCVQKCRNK

SEQ ID NO: 1915 - protein, 33 aa, synthetic construct
  REGION 1..33: note = Synthetic
FGRRGLNDLDDLDELFDGEISQADVDFLNELMR

SEQ ID NO: 1916 - protein, 19 aa, synthetic construct
  REGION 1..19: note = Synthetic
KCIDLVNNVLKEVASSRKT

SEQ ID NO: 1917 - protein, 27 aa, synthetic construct
  REGION 1..27: note = Synthetic
AFNAVKRLLDQARQLGRVNEENQGVQI

SEQ ID NO: 1918 - protein, 40 aa, synthetic construct
  REGION 1..40: note = Synthetic
EWVQRYMKNLDAKQKKASPRARAVAVKGPVQRYPGNQTTC

SEQ ID NO: 1919 - protein, 19 aa, synthetic construct
  REGION 1..19: note = Synthetic
ECVYFLQKFLKYATKHLGR

SEQ ID NO: 1920 - protein, 41 aa, synthetic construct
  REGION 1..41: note = Synthetic
CLKGIARGIHNLNEDNARSIPPKCGVNLPYTISLNIDCSRV

SEQ ID NO: 1921 - protein, 27 aa, synthetic construct
  REGION 1..27: note = Synthetic
GHQAIETGLNIFRGLFKGKKKNKKTKG

SEQ ID NO: 1922 - protein, 24 aa, synthetic construct
  REGION 1..24: note = Synthetic
DCYSACKKLVGKATGKCTNGRCDC

SEQ ID NO: 1923 - protein, 42 aa, synthetic construct
  REGION 1..42: note = Synthetic
KLAKDITKMAKQRAKEYVVKKLNGPPEEEVAAIDALMNSLDY

SEQ ID NO: 1924 - protein, 33 aa, synthetic construct
  REGION 1..33: note = Synthetic
LGKRGLNELDDLDELFDGEISQADIDFLKELMS

SEQ ID NO: 1925 - protein, 13 aa, synthetic construct
  REGION 1..13: note = Synthetic
YSRGCSKIARCRS

SEQ ID NO: 1926 - protein, 19 aa, synthetic construct
  REGION 1..19: note = Synthetic
KKVQKCLNKCYDICDVKLI

SEQ ID NO: 1927 - protein, 15 aa, synthetic construct
  REGION 1..15: note = Synthetic
NSLASHLTSFVSRWQ

SEQ ID NO: 1928 - protein, 21 aa, synthetic construct
  REGION 1..21: note = Synthetic
AGTVAKDVVKLVNDLRSCMSV

SEQ ID NO: 1929 - protein, 17 aa, synthetic construct
  REGION 1..17: note = Synthetic
NWVKRAVNLLSLRVKKM

SEQ ID NO: 1930 - protein, 21 aa, synthetic construct
  REGION 1..21: note = Synthetic
SQVFRYVTDMVKSVGVDCGRS

SEQ ID NO: 1931 - protein, 19 aa, synthetic construct
  REGION 1..19: note = Synthetic
ISNFLSTLMSIFTNPDSCK

SEQ ID NO: 1932 - protein, 33 aa, synthetic construct
  REGION 1..33: note = Synthetic
LGKRGLNNLNDFDELFDGEITKADLDFMREIMK

SEQ ID NO: 1933 - protein, 32 aa, synthetic construct
  REGION 1..32: note = Synthetic
LWSKIKAAGKEAAKAAAKAAGKAALNAVSEAV

SEQ ID NO: 1934 - protein, 32 aa, synthetic construct; identical to SEQ ID NO: 1933
  REGION 1..32: note = Synthetic

SEQ ID NO: 1935 - protein, 20 aa, synthetic construct
  REGION 1..20: note = Synthetic
IASVAAKVFSKIFCAISKKC

SEQ ID NO: 1936 - protein, 33 aa, synthetic construct
  REGION 1..33: note = Synthetic
RSLGGVISGAKKVAKVAIPIGKAVLPVVAKLVG

SEQ ID NO: 1937 - protein, 16 aa, synthetic construct
  REGION 1..16: note = Synthetic
LQAFLAKMKEIAAQTL

SEQ ID NO: 1938 - protein, 12 aa, synthetic construct
  REGION 1..12: note = Synthetic
NPLTDIINKLTD

SEQ ID NO: 1939 - protein, 33 aa, synthetic construct
  REGION 1..33: note = Synthetic
FGKRGLENMDKFDELFDGDLSEADLDFLKELMR

SEQ ID NO: 1940 - protein, 12 aa, synthetic construct
  REGION 1..12: note = Synthetic
KAALNEINQIVQ

SEQ ID NO: 1941 - protein, 39 aa, synthetic construct
  REGION 1..39: note = Synthetic
VEGLCSKFPDCNKHCKEQGFLGGQCLKLGVNMLCFCIHT

SEQ ID NO: 1942 - protein, 14 aa, synthetic construct
  REGION 1..14: note = Synthetic
RKWATPCKEIYSPN

SEQ ID NO: 1943 - protein, 42 aa, synthetic construct
  REGION 1..42: note = Synthetic
SKWIAPLERLVAFPSGVAGGVGITCWLVVCNKVVALILQAVS

SEQ ID NO: 1944 - protein, 21 aa, synthetic construct
  REGION 1..21: note = Synthetic
RVMEQVFSYLLDIIRIDVDVQ

SEQ ID NO: 1945 - protein, 23 aa, synthetic construct
  REGION 1..23: note = Synthetic
KSCKEFMENMISLAKALSAQRSP

SEQ ID NO: 1946 - protein, 33 aa, synthetic construct
  REGION 1..33: note = Synthetic
LGRRGLNELDNLDELFDGEISQADIDFLKELMS

SEQ ID NO: 1947 - protein, 39 aa, synthetic construct
  REGION 1..39: note = Synthetic
VEGLCSKFPDCNKHCKEQKFPGGTCLKLGVNMMCTCIYS

SEQ ID NO: 1948 - protein, 14 aa, synthetic construct
  REGION 1..14: note = Synthetic
YDAVYNGCLDKLRH

SEQ ID NO: 1949 - protein, 31 aa, synthetic construct
  REGION 1..31: note = Synthetic
GKGYIRGCADTCPKLQNRDVIFCCSTDKCNL

SEQ ID NO: 1950 - protein, 13 aa, synthetic construct
  REGION 1..13: note = Synthetic
KAALNAVTDMVNQ

SEQ ID NO: 1951 - protein, 22 aa, synthetic construct
  REGION 1..22: note = Synthetic
CKRCCSYAGEAMDKVTEAQPHN

SEQ ID NO: 1952 - protein, 30 aa, synthetic construct; identical to SEQ ID NO: 1892
  REGION 1..30: note = Synthetic

SEQ ID NO: 1953 - protein, 27 aa, synthetic construct
  REGION 1..27: note = Synthetic
REVDRLASDLQRLAKFQQHSTKHYGFL

SEQ ID NO: 1954 - protein, 33 aa, synthetic construct
  REGION 1..33: note = Synthetic
FGKRGLRNFDDLDDTFEPEMSEADLKYLQDLLR

SEQ ID NO: 1955 - protein, 25 aa, synthetic construct
  REGION 1..25: note = Synthetic
RGLWSTIKNVAAAAGKAALGALGEQ

SEQ ID NO: 1956 - protein, 28 aa, synthetic construct
  REGION 1..28: note = Synthetic
LNGYIDHFKNFRKRDAELEELLSKLPIY

SEQ ID NO: 1957 - protein, 41 aa, synthetic construct
  REGION 1..41: note = Synthetic
GILDTIKSIASKVWNSKTVQDLKRKGINWVANKLGVSPQAA

SEQ ID NO: 1958 - protein, 41 aa, synthetic construct
  REGION 1..41: note = Synthetic
LLDLAKHVIGIASKLGKRSEEKRGLLDFAKHVIGIASKLGK

SEQ ID NO: 1959 - protein, 14 aa, synthetic construct
  REGION 1..14: note = Synthetic
SLLSSAFSLCQQCC

SEQ ID NO: 1960 - protein, 28 aa, synthetic construct
  REGION 1..28: note = Synthetic
DCYRRFEQGVAKGVQCWCIEKDVTYKGV

SEQ ID NO: 1961 - protein, 21 aa, synthetic construct
  REGION 1..21: note = Synthetic
GIFGKILGAGKKVLCGLSGLC

SEQ ID NO: 1962 - protein, 22 aa, synthetic construct
  REGION 1..22: note = Synthetic
CKRCCSYAGEAMDKVTEAQPHN

SEQ ID NO: 1963 - protein, 26 aa, synthetic construct
  REGION 1..26: note = Synthetic
VGTALGSLAEELNGYNRKKGGFSFRF

SEQ ID NO: 1964 - protein, 18 aa, synthetic construct
  REGION 1..18: note = Synthetic
DKIVEVVKEMGKAGLNAA

SEQ ID NO: 1965 - protein, 22 aa, synthetic construct
  REGION 1..22: note = Synthetic
VKKMLKDVPKLATSSTKIAKQN

SEQ ID NO: 1966 - protein, 23 aa, synthetic construct
  REGION 1..23: note = Synthetic
VENCGDACVNFCNGDAGLTSLDA

SEQ ID NO: 1967 - protein, 19 aa, synthetic construct
  REGION 1..19: note = Synthetic
KWVQDYVKHLDQRTQTPKT

SEQ ID NO: 1968 - protein, 29 aa, synthetic construct
  REGION 1..29: note = Synthetic
SRADQFANEWGRSGKDPNFFRPPGLPSKY

SEQ ID NO: 1969 - protein, 14 aa, synthetic construct
  REGION 1..14: note = Synthetic
KVGGLLGGLLGGIL

SEQ ID NO: 1970 - protein, 14 aa, synthetic construct
  REGION 1..14: note = Synthetic
KVGGLLGGLLGGIL

SEQ ID NO: 1971 - protein, 30 aa, synthetic construct
  REGION 1..30: note = Synthetic
GWTQIKGCIHRCPESTPNEKYQCCSTDNCI

SEQ ID NO: 1972 - protein, 29 aa, synthetic construct
  REGION 1..29: note = Synthetic
KGKQLLKDYANRVLNGPEEEAAAPAERRR

SEQ ID NO: 1973 - protein, 13 aa, synthetic construct
  REGION 1..13: note = Synthetic
KIIDKMLNKASAN

SEQ ID NO: 1974 - protein, 13 aa, synthetic construct
  REGION 1..13: note = Synthetic
KIIDKMLNKASAN

SEQ ID NO: 1975 - protein, 13 aa, synthetic construct
  REGION 1..13: note = Synthetic
KIIDKMLNKASAN

SEQ ID NO: 1976 - protein, 30 aa, synthetic construct
  REGION 1..30: note = Synthetic
LWKTMLKKLGTMALHAGKAAFGAAADTISQ

SEQ ID NO: 1977 - protein, 33 aa, synthetic construct
  REGION 1..33: note = Synthetic
LWKTMLKKLGTMALHAGKAALGAAADTISQGTQ

SEQ ID NO: 1978 - protein, 22 aa, synthetic construct
  REGION 1..22: note = Synthetic
NAILNGLGKGMNFMENTFSFCV

SEQ ID NO: 1979 - protein, 13 aa, synthetic construct
  REGION 1..13: note = Synthetic
KGLIQTVGDFIGI

SEQ ID NO: 1980 - protein, 21 aa, synthetic construct
  REGION 1..21: note = Synthetic
GIFGKILGVGKKVLCGLSGMC

SEQ ID NO: 1981 - protein, 32 aa, synthetic construct
  REGION 1..32: note = Synthetic
LWKTMLKKLGTVALHAGKAALGAAADTISQGA

SEQ ID NO: 1982 - protein, 33 aa, synthetic construct
  REGION 1..33: note = Synthetic
IGKRGLKKLDQLDDTFDSDLSDADVKLLREMFK

SEQ ID NO: 1983 - protein, 30 aa, synthetic construct
  REGION 1..30: note = Synthetic
CCRKGYNGCKRCCSYAGEAMDKVTEAQPHN

SEQ ID NO: 1984 - protein, 20 aa, synthetic construct
  REGION 1..20: note = Synthetic
LLGSIGKVLGGYLAEKLKPK

SEQ ID NO: 1985 - protein, 15 aa, synthetic construct
  REGION 1..15: note = Synthetic
YRIKKFLKRCCKKIK

SEQ ID NO: 1986 - protein, 22 aa, synthetic construct
  REGION 1..22: note = Synthetic
EEFQEFMQDIEQAREEELLSRQ

SEQ ID NO: 1987 - protein, 37 aa, synthetic construct
  REGION 1..37: note = Synthetic
RDCKGLFRQCKKSSECCKGSSCESDLTGLCIFNLPGR

SEQ ID NO: 1988 - protein, 39 aa, synthetic construct
  REGION 1..39: note = Synthetic
VAHWLGGLLSRAGSVANTNLLPTSMGFKVYNRRRRELKA

SEQ ID NO: 1989 - protein, 25 aa, synthetic construct
  REGION 1..25: note = Synthetic
FNRASRLANEIGDLLQSHLIKLKME

SEQ ID NO: 1990 - protein, 31 aa, synthetic construct
  REGION 1..31: note = Synthetic
KWNSAVDSVFTTIENVPSSVNTVANRLINNK

SEQ ID NO: 1991 - protein, 21 aa, synthetic construct
  REGION 1..21: note = Synthetic
VGAALKVLANVLPPVISWIKQ

SEQ ID NO: 1992 - protein, 13 aa, synthetic construct
  REGION 1..13: note = Synthetic
AGKAALNKIAEAV

SEQ ID NO: 1993 - protein, 33 aa, synthetic construct
  REGION 1..33: note = Synthetic
EELDRLAHTVLNAVDHLATKLNRNGRSADPVGH

SEQ ID NO: 1994 - protein, 17 aa, synthetic construct
  REGION 1..17: note = Synthetic
ILSSIMGTLGKIVGLAP

SEQ ID NO: 1995 - protein, 19 aa, synthetic construct
  REGION 1..19: note = Synthetic
KWVQDAVKQLDKKAQTPKP

SEQ ID NO: 1996 - protein, 26 aa, synthetic construct
  REGION 1..26: note = Synthetic
RSAISMVTELLRAAKSGPGGGGTHFP

SEQ ID NO: 1997 - protein, 13 aa, synthetic construct
  REGION 1..13: note = Synthetic
KWVQEYINYLEMS

SEQ ID NO: 1998 - protein, 13 aa, synthetic construct
  REGION 1..13: note = Synthetic
KWVQEYINYLEMS

SEQ ID NO: 1999 - protein, 16 aa, synthetic construct
  REGION 1..16: note = Synthetic
WTQGLDNVFNMMFSYL

SEQ ID NO: 2000 - protein, 17 aa, synthetic construct
  REGION 1..17: note = Synthetic
IKTLQRVVRKIATDIDE

SEQ ID NO: 2001 - protein, 28 aa, synthetic construct
  REGION 1..28: note = Synthetic
QTAQNAIRNVINRLHGLDNFLFQLQQRQ

SEQ ID NO: 2002 - protein, 32 aa, synthetic construct
  REGION 1..32: note = Synthetic
LFNDLEHVCDDCYNLYRTSYVASACRSNCYSN

SEQ ID NO: 2003 - protein, 32 aa, synthetic construct; identical to SEQ ID NO: 2002
  REGION 1..32: note = Synthetic

SEQ ID NO: 2004 - protein, 32 aa, synthetic construct; identical to SEQ ID NO: 2002
  REGION 1..32: note = Synthetic

SEQ ID NO: 2005 - protein, 32 aa, synthetic construct
  REGION 1..32: note = Synthetic
FRDCCRDCKTAFSHLSCNAWYNGNYKLAKEVI

SEQ ID NO: 2006 - protein, 37 aa, synthetic construct
  REGION 1..37: note = Synthetic
RKAIHELIQVMAELSPAPKIGKRKRSQTLFRGRRASQ

SEQ ID NO: 2007 - protein, 29 aa, synthetic construct
  REGION 1..29: note = Synthetic
KGKQLLKDYANKVLNGPEEEAAAPAERRR

SEQ ID NO: 2008 - protein, 33 aa, synthetic construct
  REGION 1..33: note = Synthetic
LRTASYFISTLKKAAQKQLKAVSFFFQVMASLV

SEQ ID NO: 2009 - protein, 14 aa, synthetic construct
  REGION 1..14: note = Synthetic
TLINYFCENIRNCM

SEQ ID NO: 2010 - protein, 17 aa, synthetic construct
  REGION 1..17: note = Synthetic
EKCIYLMRKCFSFMTNQ

SEQ ID NO: 2011 - protein, 18 aa, synthetic construct
  REGION 1..18: note = Synthetic
DKIIDVVKEMGKAGLQAA

SEQ ID NO: 2012 - protein, 32 aa, synthetic construct
  REGION 1..32: note = Synthetic
ILDTLKNLAKTAGKGALQGLVKMASCKLSGQC

SEQ ID NO: 2013 - protein, 28 aa, synthetic construct
  REGION 1..28: note = Synthetic
DVGATWSKVIRGPGRSKPNWSIGGTYRW

SEQ ID NO: 2014 - protein, 19 aa, synthetic construct
  REGION 1..19: note = Synthetic
VLSQYLECVTQACGRTIKM

SEQ ID NO: 2015 - protein, 18 aa, synthetic construct
  REGION 1..18: note = Synthetic
KLVDSLLQVLKEKGGTAS

SEQ ID NO: 2016 - protein, 15 aa, synthetic construct
  REGION 1..15: note = Synthetic
LNNCGKQVPNGFECT

SEQ ID NO: 2017 - protein, 16 aa, synthetic construct
  REGION 1..16: note = Synthetic
AHACFQRIHRLTRTMR

SEQ ID NO: 2018 - protein, 13 aa, synthetic construct
  REGION 1..13: note = Synthetic
VTSVLAAILKPCF

SEQ ID NO: 2019 - protein, 18 aa, synthetic construct
  REGION 1..18: note = Synthetic
GDKLYREIQNWEGFTRRP

SEQ ID NO: 2020 - protein, 11 aa, synthetic construct
  REGION 1..11: note = Synthetic
LQDLNTVLRHF

SEQ ID NO: 2021 - protein, 41 aa, synthetic construct
  REGION 1..41: note = Synthetic
YKRGCEKITRCERDRRKQAHLRNPRKVLDVVAVMAKAKQLY

SEQ ID NO: 2022 - protein, 29 aa, synthetic construct
  REGION 1..29: note = Synthetic
SRADQFANEWGRSGKDPNFFRPPGLPSKY

SEQ ID NO: 2023 - protein, 22 aa, synthetic construct
  REGION 1..22: note = Synthetic
ALSRLQAALQDMLRRLDLSPGC

SEQ ID NO: 2024 - protein, 26 aa, synthetic construct
  REGION 1..26: note = Synthetic
NMARKCRECCGGNGKCFGPQCLCNRE

SEQ ID NO: 2025 - protein, 20 aa, synthetic construct
  REGION 1..20: note = Synthetic
WVDAFSTAAYIINRLLVPLL

SEQ ID NO: 2026 - protein, 25 aa, synthetic construct
  REGION 1..25: note = Synthetic
ENIRRVFNDCRDIIQRMHLRQYELL

SEQ ID NO: 2027 - protein, 34 aa, synthetic construct
  REGION 1..34: note = Synthetic
VRKIYQAAKYLPNICKIQQVGVCPFQIPSIPSYY

SEQ ID NO: 2028 - protein, 23 aa, synthetic construct
  REGION 1..23: note = Synthetic
WGDDMNDYCTGISSDCPRNPWKD

SEQ ID NO: 2029 - protein, 30 aa, synthetic construct
  REGION 1..30: note = Synthetic
RGFMDTAKNVAKNVAVTLIDKLRCKVTGGC

SEQ ID NO: 2030 - protein, 16 aa, synthetic construct
  REGION 1..16: note = Synthetic
IKDICKKVLEQFRDLL

SEQ ID NO: 2031 - protein, 37 aa, synthetic construct
  REGION 1..37: note = Synthetic
RKAIHELIQVMAELSPAPKIGKRRRSQTLFRGRRASQ

SEQ ID NO: 2032 - protein, 31 aa, synthetic construct
  REGION 1..31: note = Synthetic
TKCSTLLKQIRECASGCVNLNDDPVNKLSTR

SEQ ID NO: 2033 - protein, 32 aa, synthetic construct
  REGION 1..32: note = Synthetic
WKKVGSAAWGGVKAAAKGAAVGGLNALAKHIQ

SEQ ID NO: 2034 - protein, 17 aa, synthetic construct
  REGION 1..17: note = Synthetic
VQRVVEKFLKRAESQNS

SEQ ID NO: 2035 - protein, 16 aa, synthetic construct
  REGION 1..16: note = Synthetic
FQRFLETAYRALRHLA

SEQ ID NO: 2036 - protein, 24 aa, synthetic construct
  REGION 1..24: note = Synthetic
KGKEMLKDYAKGLLEGGSEEVPGQ

SEQ ID NO: 2037 - protein, 22 aa, synthetic construct
  REGION 1..22: note = Synthetic
IAEKVFEILQEAWKEFNSVTFG

SEQ ID NO: 2038 - protein, 17 aa, synthetic construct
  REGION 1..17: note = Synthetic
EMGSIISQAIRNAKKHV

SEQ ID NO: 2039 - protein, 19 aa, synthetic construct
  REGION 1..19: note = Synthetic
VKDIATALNQIIRRIQEES

SEQ ID NO: 2040 - protein, 19 aa, synthetic construct
  REGION 1..19: note = Synthetic
RWSSGFHKVFAEGTKLIVI

SEQ ID NO: 2041 - protein, 24 aa, synthetic construct
  REGION 1..24: note = Synthetic
GLFKVLGSVAKHLLPHVVPVIAEK

SEQ ID NO: 2042 - protein, 23 aa, synthetic construct
  REGION 1..23: note = Synthetic
GIFRFARGYVEARTKSFDLKAGC

SEQ ID NO: 2043 - protein, 31 aa, synthetic construct
  REGION 1..31: note = Synthetic
RSLWSKIKEMAATAGKAALNAVTGMVNQGEQ

SEQ ID NO: 2044 - protein, 19 aa, synthetic construct
  REGION 1..19: note = Synthetic
EKAADKAKKFGGKTKKWFG

SEQ ID NO: 2045 - protein, 20 aa, synthetic construct
  REGION 1..20: note = Synthetic
LLASLGKVFGGYLAEKLKPK

SEQ ID NO: 2046 - protein, 19 aa, synthetic construct
  REGION 1..19: note = Synthetic
KCLKTMYDCCKYSCSRGRC

SEQ ID NO: 2047 - protein, 17 aa, synthetic construct
  REGION 1..17: note = Synthetic
FLNKWITFCQSIYSTMT

SEQ ID NO: 2048 - protein, 32 aa, synthetic construct
  REGION 1..32: note = Synthetic
LFSLIKAGAKFLGKNLLKQGACYAACKASKQC

SEQ ID NO: 2049 - protein, 14 aa, synthetic construct
  REGION 1..14: note = Synthetic
EKFKRIANSFLQKN

SEQ ID NO: 2050 - protein, 15 aa, synthetic construct
  REGION 1..15: note = Synthetic
YQLLSFIRSLAHDIN

SEQ ID NO: 2051 - protein, 15 aa, synthetic construct
  REGION 1..15: note = Synthetic
YRIKKFLKRCCKKIK

SEQ ID NO: 2052 - protein, 15 aa, synthetic construct
  REGION 1..15: note = Synthetic
YRIKKFLKRCCKKIK

SEQ ID NO: 2053 - protein, 14 aa, synthetic construct
  REGION 1..14: note = Synthetic
LKELAGGLVTGIQS

SEQ ID NO: 2054 - protein, 31 aa, synthetic construct
  REGION 1..31: note = Synthetic
QDCYEALHKCMASHSKPFSCSMKFHMCLQQQ

SEQ ID NO: 2055 - protein, 26 aa, synthetic construct
  REGION 1..26: note = Synthetic
CDPCRKCVQSFHSGVYMCSDKKSNCS

SEQ ID NO: 2056 - protein, 32 aa, synthetic construct
  REGION 1..32: note = Synthetic
IMSIVKDVAKNAAKEAAKGALSTLSCKLAKTC

SEQ ID NO: 2057 - protein, 23 aa, synthetic construct
  REGION 1..23: note = Synthetic
DAAKLFSSWVDKLSKDIEENKKQ

SEQ ID NO: 2058 - protein, 19 aa, synthetic construct
  REGION 1..19: note = Synthetic
RDVLTRFKSWFKRVFGKKQ

SEQ ID NO: 2059 - protein, 15 aa, synthetic construct
  REGION 1..15: note = Synthetic
VENLVSFANSFIKTA

SEQ ID NO: 2060 - protein, 37 aa, synthetic construct
  REGION 1..37: note = Synthetic
RECRKMFGGCSKHEDCCAHLACKRTFNYCAWDGSFSK

SEQ ID NO: 2061 - protein, 29 aa, synthetic construct
  REGION 1..29: note = Synthetic
QSCIDHCKAIGEVIYVCFTYHCYCRKPPM

SEQ ID NO: 2062 - protein, 16 aa, synthetic construct
  REGION 1..16: note = Synthetic
REIPQCINSICKCMKG

SEQ ID NO: 2063 - protein, 28 aa, synthetic construct
  REGION 1..28: note = Synthetic
DIVKLLESIGSQSGTPSKIAKISNSGEL

SEQ ID NO: 2064 - protein, 32 aa, synthetic construct
  REGION 1..32: note = Synthetic
LFSLIKAGAKFLGKNLLKQGAQYAACKVSKEC

SEQ ID NO: 2065 - protein, 31 aa, synthetic construct
  REGION 1..31: note = Synthetic
LWSKIKEAGKAALTAAGKAALGAVSDAVGEQ

SEQ ID NO: 2066 - protein, 15 aa, synthetic construct
  REGION 1..15: note = Synthetic
YCRLGNTFYRLCCRQ

SEQ ID NO: 2067 - protein, 15 aa, synthetic construct
  REGION 1..15: note = Synthetic
YCRLGNTFYRLCCRQ

SEQ ID NO: 2068 - protein, 25 aa, synthetic construct
  REGION 1..25: note = Synthetic
WKDILKNAGKAALNEINQLVNQGEL

SEQ ID NO: 2069 - protein, 16 aa, synthetic construct
  REGION 1..16: note = Synthetic
VDSAIEKALTVWEEVT

SEQ ID NO: 2070 - protein, 37 aa, synthetic construct
  REGION 1..37: note = Synthetic
RGLWSNIKTAGKEAAKAALKAAGKAALGAVTDAVGEQ

SEQ ID NO: 2071 - protein, 12 aa, synthetic construct
  REGION 1..12: note = Synthetic
NFGGKVITIFKA

SEQ ID NO: 2072 - protein, 32 aa, synthetic construct
  REGION 1..32: note = Synthetic
IMDTLKNLAKTAGKGALQSLLNKASCKLSGQC

SEQ ID NO: 2073 - protein, 32 aa, synthetic construct
  REGION 1..32: note = Synthetic
IMDTLKNLAKTAGKGALQSLVKMASCKLSGQC

SEQ ID NO: 2074 - protein, 14 aa, synthetic construct
  REGION 1..14: note = Synthetic
LSGIIDSVANAIKG

SEQ ID NO: 2075 - protein, 26 aa, synthetic construct
  REGION 1..26: note = Synthetic
GQCDECCKKAGDRAGNCVYFKCKCNP

SEQ ID NO: 2076 - protein, 26 aa, synthetic construct
  REGION 1..26: note = Synthetic
GQCDECCKKAGDRAGNCVYLKCKCNQ

SEQ ID NO: 2077 - protein, 42 aa, synthetic construct
  REGION 1..42: note = Synthetic
CITFCNKCCRKCLCVPPGYYGNKQVCSCYNNWKTQEGGPKCP

SEQ ID NO: 2078 - protein, 20 aa, synthetic construct
  REGION 1..20: note = Synthetic
LRDYLRQINEYFAIIGRPRF

SEQ ID NO: 2079 - protein, 35 aa, synthetic construct
  REGION 1..35: note = Synthetic
SHFQEFLEKACHFLKLPLGTNITLLSPGSPHRVTC

SEQ ID NO: 2080 - protein, 15 aa, synthetic construct
  REGION 1..15: note = Synthetic
KYIEKVVDKARTVVG

SEQ ID NO: 2081 - protein, 26 aa, synthetic construct
  REGION 1..26: note = Synthetic
WAQSLVSLFQALRHDLMRSSQPGVPP

SEQ ID NO: 2082 - protein, 39 aa, synthetic construct
  REGION 1..39: note = Synthetic
ENFFKEIERAGQRIRDAIISAAPAVETLAQAQKIIKGGD

SEQ ID NO: 2083 - protein, 23 aa, synthetic construct
  REGION 1..23: note = Synthetic
FSQARSCCSRLGRCCHVGKGYSG

SEQ ID NO: 2084 - protein, 23 aa, synthetic construct
  REGION 1..23: note = Synthetic
FSQARSCCSRLGRCCHVGKGYSG

SEQ ID NO: 2085 - protein, 15 aa, synthetic construct
  REGION 1..15: note = Synthetic
KYIEKVVDKAKTVVG

SEQ ID NO: 2086 - protein, 15 aa, synthetic construct
  REGION 1..15: note = Synthetic
KYIEKVVDKAKTVVG

SEQ ID NO: 2087 - protein, 15 aa, synthetic construct
  REGION 1..15: note = Synthetic
KYIEKVVDKAKTVVG

SEQ ID NO: 2088 - protein, 15 aa, synthetic construct
  REGION 1..15: note = Synthetic
KYIEKVVDKAKTVVG

SEQ ID NO: 2089 - protein, 42 aa, synthetic construct
  REGION 1..42: note = Synthetic
ITQAIQCAKRVVRDPQGIRAWVAWQRHCKNRDLSGYIRNCGV

SEQ ID NO: 2090 - protein, 17 aa, synthetic construct
  REGION 1..17: note = Synthetic
DQAEKIAKDIIKKVRGH

SEQ ID NO: 2091 - protein, 23 aa, synthetic construct
  REGION 1..23: note = Synthetic
ERCTKLANTFFQQCKTMSEYTVY

SEQ ID NO: 2092 - protein, 18 aa, synthetic construct
  REGION 1..18: note = Synthetic
KRVKRFCKKACRKASQSK

SEQ ID NO: 2093 - protein, 18 aa, synthetic construct
  REGION 1..18: note = Synthetic
KRVKRFCKKACRKASQSK

SEQ ID NO: 2094 - protein, 20 aa, synthetic construct
  REGION 1..20: note = Synthetic
LLASLGKVLGGYLAEKLKPK

SEQ ID NO: 2095 - protein, 16 aa, synthetic construct
  REGION 1..16: note = Synthetic
CATLLRECAKECSNVH

SEQ ID NO: 2096 - protein, 36 aa, synthetic construct
  REGION 1..36: note = Synthetic
IFSLVKGAAKLAGKGLAKEGGKFGLELIACKIAKQC

SEQ ID NO: 2097 - protein, 19 aa, synthetic construct
  REGION 1..19: note = Synthetic
SAMERLNNWLKTFKHPPHH

SEQ ID NO: 2098 - protein, 21 aa, synthetic construct
  REGION 1..21: note = Synthetic
AGTVAKDVVKLVNDLRSCMSV

SEQ ID NO: 2099 - protein, 22 aa, synthetic construct
  REGION 1..22: note = Synthetic
KTLARWAQNAFSKLLRSRATKP

SEQ ID NO: 2100 - protein, 22 aa, synthetic construct
  REGION 1..22: note = Synthetic
KTLARWAQNAFSKLLRSRATKP

SEQ ID NO: 2101 - protein, 42 aa, synthetic construct
  REGION 1..42: note = Synthetic
KEGCRKFLGGCENTGQCCLHLFCKYDTPFNHFCAWDLSFGRK

SEQ ID NO: 2102 - protein, 17 aa, synthetic construct
  REGION 1..17: note = Synthetic
FLNKWITFCQSIYSTMT

SEQ ID NO: 2103 - protein, 25 aa, synthetic construct
  REGION 1..25: note = Synthetic
SKAVEQVKEAFSKLQEKGVYKAMNE

SEQ ID NO: 2104 - protein, 15 aa, synthetic construct
  REGION 1..15: note = Synthetic
CAQTIVKCIQNCVNP

SEQ ID NO: 2105 - protein, 22 aa, synthetic construct
  REGION 1..22: note = Synthetic
CKRCCSYAGEAMDKVTEVQPHN

SEQ ID NO: 2106 - protein, 19 aa, synthetic construct
  REGION 1..19: note = Synthetic
KAIKNLLKAVSKERSKRSP

SEQ ID NO: 2107 - protein, 32 aa, synthetic construct
  REGION 1..32: note = Synthetic
RGFLSTVKNLATNVAGTVIDTIKCKVTGGCRK

SEQ ID NO: 2108 - protein, 36 aa, synthetic construct
  REGION 1..36: note = Synthetic
TGIVNGIKSLVKGVGMKVFKAGLNNIGNTGCNEDEC

SEQ ID NO: 2109 - protein, 36 aa, synthetic construct
  REGION 1..36: note = Synthetic
TGIVNGIKSLVKGVGMKVFKAGLSNIGNTGCNEDEC

SEQ ID NO: 2110 - protein, 36 aa, synthetic construct; identical to SEQ ID NO: 2109
  REGION 1..36: note = Synthetic

SEQ ID NO: 2111 - protein, 20 aa, synthetic construct
  REGION 1..20: note = Synthetic
MAEQLMEKIKKLWYSRVQGY

SEQ ID NO: 2112 - protein, 24 aa, synthetic construct
  REGION 1..24: note = Synthetic
LLQEFQEILKEATELRFSGLPDTL

SEQ ID NO: 2113 - protein, 19 aa, synthetic construct
  REGION 1..19: note = Synthetic
RLQKCLHSIIKHLDHIQRC

SEQ ID NO: 2114 - protein, 42 aa, synthetic construct
  REGION 1..42: note = Synthetic
ITAAIQCAKRVVRDPQGIRAWVAWRTQCQNRDLSQYIRNCGV

SEQ ID NO: 2115 - protein, 34 aa, synthetic construct
  REGION 1..34: note = Synthetic
KKAVSSWYRAIDTLSQTIGIFRPRSLWNRSENNS

SEQ ID NO: 2116 - protein, 11 aa, synthetic construct
  REGION 1..11: note = Synthetic
LKTLQKLMENY

SEQ ID NO: 2117 - protein, 19 aa, synthetic construct
  REGION 1..19: note = Synthetic
KICRRCCSSAEEALNNKKN

SEQ ID NO: 2118 - protein, 34 aa, synthetic construct
  REGION 1..34: note = Synthetic
TCPKLIKSLVEIADQLDDDLDSTPQELCKFVYFC

SEQ ID NO: 2119 - protein, 33 aa, synthetic construct
  REGION 1..33: note = Synthetic
ASVRKICSRCVALKRHGVLIVLCSNPKHKQRQG

SEQ ID NO: 2120 - protein, 27 aa, synthetic construct
  REGION 1..27: note = Synthetic
KLFRVYANFLRGKLKLYTGEVCRRGDR

SEQ ID NO: 2121 - protein, 33 aa, synthetic construct
  REGION 1..33: note = Synthetic
FGKRGLKNLDQYNDLFDGEISDADIKYLQDLMR

SEQ ID NO: 2122 - protein, 38 aa, synthetic construct
  REGION 1..38: note = Synthetic
DNLHDYCTGISSDCPRNPYKGKYDPMKWPAAAKGSVLM

SEQ ID NO: 2123 - protein, 15 aa, synthetic construct
  REGION 1..15: note = Synthetic
ARSALENIASTVTKF

SEQ ID NO: 2124 - protein, 40 aa, synthetic construct
  REGION 1..40: note = Synthetic
YIKAAWQIGKHALGDMTDEEFQDFMKEVEQAREEELQSRQ

SEQ ID NO: 2125 - protein, 26 aa, synthetic construct
  REGION 1..26: note = Synthetic
HQCDECCKKAGDRAGNCVYYKCKCNP

SEQ ID NO: 2126 - protein, 14 aa, synthetic construct
  REGION 1..14: note = Synthetic
EKFKRIANSFLQKN

SEQ ID NO: 2127 - protein, 14 aa, synthetic construct
  REGION 1..14: note = Synthetic
EKFKRIANSFLQKN

SEQ ID NO: 2128 - protein, 14 aa, synthetic construct
  REGION 1..14: note = Synthetic
EKFKRIANSFLQKN

SEQ ID NO: 2129 - protein, 17 aa, synthetic construct
  REGION 1..17: note = Synthetic
FLNRWITFCQSIISTLT

SEQ ID NO: 2130 - protein, 17 aa, synthetic construct
  REGION 1..17: note = Synthetic
FLNRWITFCQSIISTLT

SEQ ID NO: 2131 - protein, 17 aa, synthetic construct
  REGION 1..17: note = Synthetic
FLNRWITFCQSIISTLT

SEQ ID NO: 2132 - protein, 17 aa, synthetic construct
  REGION 1..17: note = Synthetic
FLNRWITFCQSIISTLT

SEQ ID NO: 2133 - protein, 17 aa, synthetic construct
  REGION 1..17: note = Synthetic
FLNRWITFCQSIISTLT

SEQ ID NO: 2134 - protein, 17 aa, synthetic construct
  REGION 1..17: note = Synthetic
FLNRWITFCQSIISTLT

SEQ ID NO: 2135 - protein, 17 aa, synthetic construct
  REGION 1..17: note = Synthetic
FLNRWITFCQSIISTLT

SEQ ID NO: 2136 - protein, 17 aa, synthetic construct
  REGION 1..17: note = Synthetic
FLNRWITFCQSIISTLT

SEQ ID NO: 2137 - protein, 17 aa, synthetic construct
  REGION 1..17: note = Synthetic
FLNRWITFCQSIISTLT

SEQ ID NO: 2138 - protein, 42 aa, synthetic construct
  REGION 1..42: note = Synthetic
ITQAVACAKRVVRDPQGIKAWVAWRNKCQNRDLRSYVQGCRV

SEQ ID NO: 2139 - protein, 22 aa, synthetic construct
  REGION 1..22: note = Synthetic
VYQCMDRVPNFCQRRCSAIAAH

SEQ ID NO: 2140 - protein, 24 aa, synthetic construct
  REGION 1..24: note = Synthetic
VENCADACVSFCNGDAGLPSLDAY

SEQ ID NO: 2141 - protein, 20 aa, synthetic construct
  REGION 1..20: note = Synthetic
ATTFIEKLMTFIRKASRNAR

SEQ ID NO: 2142 - protein, 13 aa, synthetic construct
  REGION 1..13: note = Synthetic
KCMNKACKCYGCV

SEQ ID NO: 2143 - protein, 17 aa, synthetic construct
  REGION 1..17: note = Synthetic
FLNKWITFCQSIFSTLT

SEQ ID NO: 2144 - protein, 17 aa, synthetic construct
  REGION 1..17: note = Synthetic
FLNKWITFCQSIFSTLT

SEQ ID NO: 2145 - protein, 33 aa, synthetic construct
  REGION 1..33: note = Synthetic
LGKRGLKNADRLDELFDGDISDADLDFLRELMR

SEQ ID NO: 2146 - protein, 25 aa, synthetic construct
  REGION 1..25: note = Synthetic
SMLSVLKNLGKVGLGFVACKINKQC

SEQ ID NO: 2147 - protein, 30 aa, synthetic construct
  REGION 1..30: note = Synthetic
RGFMDTAKQVAKNVAVTLIDKLRCKVTGGC

SEQ ID NO: 2148 - protein, 32 aa, synthetic construct
  REGION 1..32: note = Synthetic
CKELGHRGGRCVDSPSKHCPGVLKNNKQCHCY

SEQ ID NO: 2149 - protein, 21 aa, synthetic construct
  REGION 1..21: note = Synthetic
KKAASVIQKILKDFGLNGGRE

SEQ ID NO: 2150 - protein, 21 aa, synthetic construct
  REGION 1..21: note = Synthetic
KKAASVIQKILKDFGLNGGRE

SEQ ID NO: 2151 - protein, 28 aa, synthetic construct
  REGION 1..28: note = Synthetic
DCYRRFEQGVAKGTQCWCIEKDVTYKGV

SEQ ID NO: 2152 - protein, 27 aa, synthetic construct
  REGION 1..27: note = Synthetic
LLDTIKGVAKTVAASMLDKLKCKISGC

SEQ ID NO: 2153 - protein, 13 aa, synthetic construct
  REGION 1..13: note = Synthetic
KCMNKVCKCYGCG

SEQ ID NO: 2154 - protein, 22 aa, synthetic construct
  REGION 1..22: note = Synthetic
VYSLADKIANALRYGGKNIILL

SEQ ID NO: 2155 - protein, 19 aa, synthetic construct
  REGION 1..19: note = Synthetic
KAIKNLLKAVSKERSKRSP

SEQ ID NO: 2156 - protein, 32 aa, synthetic construct
  REGION 1..32: note = Synthetic
IMSIVKDVAKTAAKEAAKGALSTLSCKLAKTC

SEQ ID NO: 2157 - protein, 15 aa, synthetic construct
  REGION 1..15: note = Synthetic
DFLHELTNFVRYLQK

SEQ ID NO: 2158 - protein, 16 aa, synthetic construct
  REGION 1..16: note = Synthetic
KTLQRVVRKIASDIDE

SEQ ID NO: 2159 - protein, 34 aa, synthetic construct
  REGION 1..34: note = Synthetic
NICGSVIRPLDCTRRKSRMGRFARTNCKKLCGFC

SEQ ID NO: 2160 - protein, 19 aa, synthetic construct
  REGION 1..19: note = Synthetic
KWVSEYMEILDQKSQILQP

SEQ ID NO: 2161 - protein, 34 aa, synthetic construct
  REGION 1..34: note = Synthetic
RVIKCIDHICQYARNLPDFASGISESTKMPCKGE

SEQ ID NO: 2162 - protein, 14 aa, synthetic construct
  REGION 1..14: note = Synthetic
YQRGCEKINRCRGG

SEQ ID NO: 2163 - protein, 23 aa, synthetic construct
  REGION 1..23: note = Synthetic
VEQCGDACVNFCNADAGLTSLDA

SEQ ID NO: 2164 - protein, 12 aa, synthetic construct
  REGION 1..12: note = Synthetic
FYGGYSGLGSSI

SEQ ID NO: 2165 - protein, 35 aa, synthetic construct
  REGION 1..35: note = Synthetic
WEDIVEGAKKIFEKCTEASSEVLGQAFAKDGWNVK

SEQ ID NO: 2166 - protein, 25 aa, synthetic construct
  REGION 1..25: note = Synthetic
SMLSVLKNLGKVGLGLVACKINKQC

SEQ ID NO: 2167 - protein, 17 aa, synthetic construct
  REGION 1..17: note = Synthetic
EELSQMANNCMQLANMM

SEQ ID NO: 2168 - protein, 17 aa, synthetic construct
  REGION 1..17: note = Synthetic
EELSQMANNCMQLANMM

SEQ ID NO: 2169 - protein, 17 aa, synthetic construct
  REGION 1..17: note = Synthetic
EELSQMANNCMQLANMM

SEQ ID NO: 2170 - protein, 17 aa, synthetic construct
  REGION 1..17: note = Synthetic
EELSQMANNCMQLANMM

SEQ ID NO: 2171 - protein, 14 aa, synthetic construct
  REGION 1..14: note = Synthetic
YSRGCSKIHRCRRD

SEQ ID NO: 2172 - protein, 14 aa, synthetic construct
  REGION 1..14: note = Synthetic
YSRGCSKIHRCRRD

SEQ ID NO: 2173 - protein, 14 aa, synthetic construct
  REGION 1..14: note = Synthetic
YSRGCSKIHRCRRD

SEQ ID NO: 2174 - protein, 22 aa, synthetic construct
  REGION 1..22: note = Synthetic
VYQCMDRVPNFCDRRCTAAAAH

SEQ ID NO: 2175 - protein, 19 aa, synthetic construct
  REGION 1..19: note = Synthetic
AWFSEAFGKVKEKLKTTFS

SEQ ID NO: 2176 - protein, 12 aa, synthetic construct
  REGION 1..12: note = Synthetic
FYGAYSGLGSSL

SEQ ID NO: 2177 - protein, 12 aa, synthetic construct
  REGION 1..12: note = Synthetic
FYGAYSGLGSSL

SEQ ID NO: 2178 - protein, 12 aa, synthetic construct
  REGION 1..12: note = Synthetic
FYGAYSGLGSSL

SEQ ID NO: 2179 - protein, 12 aa, synthetic construct
  REGION 1..12: note = Synthetic
FYGAYSGLGSSL

SEQ ID NO: 2180 - protein, 14 aa, synthetic construct
  REGION 1..14: note = Synthetic
KVIGVIGHLIHPPS

SEQ ID NO: 2181 - protein, 35 aa, synthetic construct
  REGION 1..35: note = Synthetic
DIESCLNECFRVYNTGFATCRGDKYSQLCTCEYNC

SEQ ID NO: 2182 - protein, 12 aa, synthetic construct
  REGION 1..12: note = Synthetic
IYGSYSGIGSSL

SEQ ID NO: 2183 - protein, 17 aa, synthetic construct
  REGION 1..17: note = Synthetic
EELSQMANNCMQLANMM

SEQ ID NO: 2184 - protein, 24 aa, synthetic construct
  REGION 1..24: note = Synthetic
RAAKDFLTTLLTILEWMNNKGCSH

SEQ ID NO: 2185 - protein, 32 aa, synthetic construct
  REGION 1..32: note = Synthetic
SILNPFRRVCNDWYNGFPGRRCTEAAGSGGNN

SEQ ID NO: 2186 - protein, 32 aa, synthetic construct
  REGION 1..32: note = Synthetic
IMDTLKNLAKTAGKGALQSLLNHASCKLSGQC

SEQ ID NO: 2187 - protein, 11 aa, synthetic construct
  REGION 1..11: note = Synthetic
TVLSYCHHIIS

SEQ ID NO: 2188 - protein, 32 aa, synthetic construct
  REGION 1..32: note = Synthetic
LISGLKNVGKEVGMDVVRTGIDIAGCKIKGEC

SEQ ID NO: 2189 - protein, 32 aa, synthetic construct; identical to SEQ ID NO: 2188
  REGION 1..32: note = Synthetic

SEQ ID NO: 2190 - protein, 16 aa, synthetic construct
  REGION 1..16: note = Synthetic
KVSNWWKRIWEKIKNK

SEQ ID NO: 2191 - protein, 16 aa, synthetic construct
  REGION 1..16: note = Synthetic
KVSNWWKRIWEKIKNK

SEQ ID NO: 2192 - protein, 32 aa, synthetic construct
  REGION 1..32: note = Synthetic
HSLLKILSTFLYQLFSSSLIVAVLTFIPFFIL

SEQ ID NO: 2193 - protein, 26 aa, synthetic construct
  REGION 1..26: note = Synthetic
GQCDECCKKAGERVGTCVYYKCKCNP

SEQ ID NO: 2194 - protein, 24 aa, synthetic construct
  REGION 1..24: note = Synthetic
EVLEIIHHFVEILDRYFGSVSVSL

SEQ ID NO: 2195 - protein, 27 aa, synthetic construct
  REGION 1..27: note = Synthetic
AGNALTFLKSLLEIFQKEKMRGMRGKI

SEQ ID NO: 2196 - protein, 24 aa, synthetic construct
  REGION 1..24: note = Synthetic
KKCATCCGGIGRCFGPQCLCNRGY

SEQ ID NO: 2197 - protein, 12 aa, synthetic construct
  REGION 1..12: note = Synthetic
IYGSYSGIGSAL

SEQ ID NO: 2198 - protein, 24 aa, synthetic construct
  REGION 1..24: note = Synthetic
VYHCMDRIANFCQRRCSPAAATAH

SEQ ID NO: 2199 - protein, 35 aa, synthetic construct
  REGION 1..35: note = Synthetic
LQNVTTCLERCIEVAQILKRISSRLDKRWTGNADN

SEQ ID NO: 2200 - protein, 17 aa, synthetic construct
  REGION 1..17: note = Synthetic
LKDFLESLKSIMQMDYS

SEQ ID NO: 2201 - protein, 32 aa, synthetic construct
  REGION 1..32: note = Synthetic
FGKRGLNDLSDLDELFDGEISEADVDFLREIM

SEQ ID NO: 2202 - protein, 15 aa, synthetic construct
  REGION 1..15: note = Synthetic
LEYIFKNIFQVASTF

SEQ ID NO: 2203 - protein, 19 aa, synthetic construct
  REGION 1..19: note = Synthetic
HKMKKLLRYLNYVAEHTAV

SEQ ID NO: 2204 - protein, 19 aa, synthetic construct
  REGION 1..19: note = Synthetic
LLASLGKVLGGYLAEKLKP

SEQ ID NO: 2205 - protein, 17 aa, synthetic construct
  REGION 1..17: note = Synthetic
GRKLYNEIRRWDHFLDN

SEQ ID NO: 2206 - protein, 23 aa, synthetic construct
  REGION 1..23: note = Synthetic
NFLNDIGKRGFHWAPSAKAAKFY

SEQ ID NO: 2207 - protein, 22 aa, synthetic construct
  REGION 1..22: note = Synthetic
VYQCMDRVPNFCQRRCSAIAAH

SEQ ID NO: 2208 - protein, 41 aa, synthetic construct
  REGION 1..41: note = Synthetic
SKAVEQVKRVFNMLQERGVYKAMSEFDIFINYIESYMTTKM

SEQ ID NO: 2209 - protein, 22 aa, synthetic construct
  REGION 1..22: note = Synthetic
LKKATRVVYKAASAAAREMNRN

SEQ ID NO: 2210 - protein, 22 aa, synthetic construct
  REGION 1..22: note = Synthetic
VYQCMDRVPNFCQRRCSAIAAH

SEQ ID NO: 2211 - protein, 37 aa, synthetic construct
  REGION 1..37: note = Synthetic
RDCRKMFGGCSKHEDCCAHLACKRTFNYCAWDGSFSK

SEQ ID NO: 2212 - protein, 29 aa, synthetic construct
  REGION 1..29: note = Synthetic
LIRFGRSAAAPLIRFGRASSAPLIRFGRK

SEQ ID NO: 2213 - protein, 19 aa, synthetic construct
  REGION 1..19: note = Synthetic
EFLRRWIAICQSIISTMTQ

SEQ ID NO: 2214 - protein, 31 aa, synthetic construct
  REGION 1..31: note = Synthetic
NPAEKWVQRLMRLVDVQNMKQMTEGRIGDSL

SEQ ID NO: 2215 - protein, 20 aa, synthetic construct
  REGION 1..20: note = Synthetic
IASVAANVFSKIFCAISKKC

SEQ ID NO: 2216 - protein, 19 aa, synthetic construct
  REGION 1..19: note = Synthetic
KAFSLADSILTGTSKVIVL

SEQ ID NO: 2217 - protein, 17 aa, synthetic construct
  REGION 1..17: note = Synthetic
ILGDWSNAISALYCRCS

SEQ ID NO: 2218 - protein, 18 aa, synthetic construct
  REGION 1..18: note = Synthetic
KFLSEIIDTCNERLDKIL

SEQ ID NO: 2219 - protein, 23 aa, synthetic construct
  REGION 1..23: note = Synthetic
FLKRLLQEIKTCWNKILSGTKEH

SEQ ID NO: 2220 - protein, 12 aa, synthetic construct
  REGION 1..12: note = Synthetic
IYGSYSGLGSSL

SEQ ID NO: 2221 - protein, 12 aa, synthetic construct
  REGION 1..12: note = Synthetic
IYGSYSGLGSSL

SEQ ID NO: 2222 - protein, 12 aa, synthetic construct
  REGION 1..12: note = Synthetic
IYGSYSGLGSSL

SEQ ID NO: 2223 - protein, 25 aa, synthetic construct
  REGION 1..25: note = Synthetic
YFHSFLDTFSKYLGSTSCPLLRLSR

SEQ ID NO: 2224 - protein, 17 aa, synthetic construct
  REGION 1..17: note = Synthetic
TLLKILSTFLYQLFSSS

SEQ ID NO: 2225 - protein, 35 aa, synthetic construct
  REGION 1..35: note = Synthetic
CSEAAYMINDLAETLGNNNEGDSLFKMTVRWKSFL

SEQ ID NO: 2226 - protein, 19 aa, synthetic construct
  REGION 1..19: note = Synthetic
KEFLNKWITFCQSILSTLA

SEQ ID NO: 2227 - protein, 26 aa, synthetic construct
  REGION 1..26: note = Synthetic
GLWNKIKEAASKAAGKAALGFVNEMV

SEQ ID NO: 2228 - protein, 36 aa, synthetic construct
  REGION 1..36: note = Synthetic
ALIKGAIHGGRFIHGMIQNHHGYDEQQELNKRAVDE

SEQ ID NO: 2229 - protein, 12 aa, synthetic construct
  REGION 1..12: note = Synthetic
FYGAYHGLGSSL

SEQ ID NO: 2230 - protein, 12 aa, synthetic construct
  REGION 1..12: note = Synthetic
LYGAYSGLGSSL

SEQ ID NO: 2231 - protein, 42 aa, synthetic construct
  REGION 1..42: note = Synthetic
ITEAVRCAKRIVSDGDGMNAWVAWRNRCRGTDVSKWIRGCRL

SEQ ID NO: 2232 - protein, 12 aa, synthetic construct
  REGION 1..12: note = Synthetic
FYGSYSGLGSSL

SEQ ID NO: 2233 - protein, 12 aa, synthetic construct
  REGION 1..12: note = Synthetic
FYGSYSGLGSSL

SEQ ID NO: 2234 - protein, 12 aa, synthetic construct
  REGION 1..12: note = Synthetic
FYGSYSGLGSSL

SEQ ID NO: 2235 - protein, 12 aa, synthetic construct
  REGION 1..12: note = Synthetic
FYGSYSGLGSSL

SEQ ID NO: 2236 - protein, 12 aa, synthetic construct
  REGION 1..12: note = Synthetic
FYGSYSGLGSSL

SEQ ID NO: 2237 - protein, 12 aa, synthetic construct
  REGION 1..12: note = Synthetic
FYGSYSGLGSSL

SEQ ID NO: 2238 - protein, 12 aa, synthetic construct
  REGION 1..12: note = Synthetic
FYGSYSGLGSSL

SEQ ID NO: 2239 - protein, 12 aa, synthetic construct
  REGION 1..12: note = Synthetic
FYGSYSGLGSSL

SEQ ID NO: 2240 - protein, 23 aa, synthetic construct
  REGION 1..23: note = Synthetic
FSQARSCCSRLGRCCHVGKGYSG

SEQ ID NO: 2241 - protein, 23 aa, synthetic construct
  REGION 1..23: note = Synthetic
FSQARSCCSRLGRCCHVGKGYSG

SEQ ID NO: 2242 - protein, 23 aa, synthetic construct
  REGION 1..23: note = Synthetic
FSQARSCCSRLGRCCHVGKGYSG

SEQ ID NO: 2243 - protein, 23 aa, synthetic construct
  REGION 1..23: note = Synthetic
FSQARSCCSRLGRCCHVGKGYSG

SEQ ID NO: 2244 - protein, 23 aa, synthetic construct
  REGION 1..23: note = Synthetic
FSQARSCCSRLGRCCHVGKGYSG

SEQ ID NO: 2245 - protein, 23 aa, synthetic construct
  REGION 1..23: note = Synthetic
FSQARSCCSRLGRCCHVGKGYSG

SEQ ID NO: 2246 - protein, 23 aa, synthetic construct
  REGION 1..23: note = Synthetic
FSQARSCCSRLGRCCHVGKGYSG

SEQ ID NO: 2247 - protein, 23 aa, synthetic construct
  REGION 1..23: note = Synthetic
FSQARSCCSRLGRCCHVGKGYSG

SEQ ID NO: 2248 - protein, 23 aa, synthetic construct
  REGION 1..23: note = Synthetic
FSQARSCCSRLGRCCHVGKGYSG

SEQ ID NO: 2249 - protein, 23 aa, synthetic construct
  REGION 1..23: note = Synthetic
FSQARSCCSRLGRCCHVGKGYSG

SEQ ID NO: 2250 - protein, 23 aa, synthetic construct
  REGION 1..23: note = Synthetic
FSQARSCCSRLGRCCHVGKGYSG

SEQ ID NO: 2251 - protein, 23 aa, synthetic construct
  REGION 1..23: note = Synthetic
FSQARSCCSRLGRCCHVGKGYSG

SEQ ID NO: 2252 - protein, 23 aa, synthetic construct
  REGION 1..23: note = Synthetic
FSQARSCCSRLGRCCHVGKGYSG

SEQ ID NO: 2253 - protein, 23 aa, synthetic construct
  REGION 1..23: note = Synthetic
FSQARSCCSRLGRCCHVGKGYSG

SEQ ID NO: 2254 - protein, 23 aa, synthetic construct
  REGION 1..23: note = Synthetic
FSQARSCCSRLGRCCHVGKGYSG

SEQ ID NO: 2255 - protein, 23 aa, synthetic construct
  REGION 1..23: note = Synthetic
FSQARSCCSRLGRCCHVGKGYSG

SEQ ID NO: 2256 - protein, 23 aa, synthetic construct
  REGION 1..23: note = Synthetic
FSQARSCCSRLGRCCHVGKGYSG

SEQ ID NO: 2257 - protein, 23 aa, synthetic construct
  REGION 1..23: note = Synthetic
FSQARSCCSRLGRCCHVGKGYSG

SEQ ID NO: 2258 - protein, 23 aa, synthetic construct
  REGION 1..23: note = Synthetic
FSQARSCCSRLGRCCHVGKGYSG

SEQ ID NO: 2259 - protein, 40 aa, synthetic construct
  REGION 1..40: note = Synthetic
TWVRDVVRSMDRKSNTRNNMIQTKPTGTQQSTNTAVTLTG

SEQ ID NO: 2260 - protein, 42 aa, synthetic construct
  REGION 1..42: note = Synthetic
IADAVACAKRVVRDPQGIRAWVAWRNRCQNRDVRQYVQGCGV

SEQ ID NO: 2261 - protein, 42 aa, synthetic construct; identical to SEQ ID NO: 2260
  REGION 1..42: note = Synthetic

SEQ ID NO: 2262 - protein, 42 aa, synthetic construct
  REGION 1..42: note = Synthetic
IADAVACAKRVVRDPQGIRAWVAWRNRCQNRDLRQYIQGCGV

SEQ ID NO: 2263 - protein, 42 aa, synthetic construct; identical to SEQ ID NO: 2260
  REGION 1..42: note = Synthetic

SEQ ID NO: 2264 - protein, 42 aa, synthetic construct; identical to SEQ ID NO: 2260
  REGION 1..42: note = Synthetic

SEQ ID NO: 2265 - protein, 42 aa, synthetic construct; identical to SEQ ID NO: 2260
  REGION 1..42: note = Synthetic

SEQ ID NO: 2266 - protein, 34 aa, synthetic construct
  REGION 1..34: note = Synthetic
LLRQVNSLADNVVKPEEGIDINAVHGLDTRSPET

SEQ ID NO: 2267 - protein, 34 aa, synthetic construct
  REGION 1..34: note = Synthetic
LADTLAKLAKNIATDRASAGKPSRAVSFVGKTRV

SEQ ID NO: 2268 - protein, 20 aa, synthetic construct
  REGION 1..20: note = Synthetic
RGCSRCCSYVGEAVQTQPGH

SEQ ID NO: 2269 - protein, 33 aa, synthetic construct; identical to SEQ ID NO: 1815
  REGION 1..33: note = Synthetic

SEQ ID NO: 2270 - protein, 32 aa, synthetic construct
  REGION 1..32: note = Synthetic
KGKELLRDYANRVLSPEEEAAAPAPVPAKRRR

SEQ ID NO: 2271 - protein, 12 aa, synthetic construct
  REGION 1..12: note = Synthetic
GKAVLNAASEAL

SEQ ID NO: 2272 - protein, 22 aa, synthetic construct
  REGION 1..22: note = Synthetic
NQFLDYLQEFLGVMNTEWIIES

SEQ ID NO: 2273 - protein, 25 aa, synthetic construct
  REGION 1..25: note = Synthetic
VLDTVTKAIETFAKVDANEARPKSQ

SEQ ID NO: 2274 - protein, 12 aa, synthetic construct
  REGION 1..12: note = Synthetic
GVPRVMSDAGRR

SEQ ID NO: 2275 - protein, 21 aa, synthetic construct
  REGION 1..21: note = Synthetic
VEKLTKALSTIRQCIISKIKK

SEQ ID NO: 2276 - protein, 16 aa, synthetic construct
  REGION 1..16: note = Synthetic
EDIFEEANRIATDLRQ

SEQ ID NO: 2277 - protein, 19 aa, synthetic construct
  REGION 1..19: note = Synthetic
KTIKSLVKAISKKRSRRSP

SEQ ID NO: 2278 - protein, 32 aa, synthetic construct; identical to SEQ ID NO: 2188
  REGION 1..32: note = Synthetic

SEQ ID NO: 2279 - protein, 32 aa, synthetic construct; identical to SEQ ID NO: 2188
  REGION 1..32: note = Synthetic

SEQ ID NO: 2280 - protein, 32 aa, synthetic construct; identical to SEQ ID NO: 2188
  REGION 1..32: note = Synthetic

SEQ ID NO: 2281 - protein, 32 aa, synthetic construct; identical to SEQ ID NO: 2188
  REGION 1..32: note = Synthetic

SEQ ID NO: 2282 - protein, 42 aa, synthetic construct
  REGION 1..42: note = Synthetic
CIKSLAADISDINYGVAAGLPGQCNVHIPYKISPSIDCKRVK

SEQ ID NO: 2283 - protein, 19 aa, synthetic construct
  REGION 1..19: note = Synthetic
KWVQKVVQAFLKRAEKQDP

SEQ ID NO: 2284 - protein, 13 aa, synthetic construct
  REGION 1..13: note = Synthetic
AVKKLLEALSHLV

SEQ ID NO: 2285 - protein, 27 aa, synthetic construct
  REGION 1..27: note = Synthetic
KLFRIYSNFLRGKLTLYTGEACRRGDR

SEQ ID NO: 2286 - protein, 36 aa, synthetic construct
  REGION 1..36: note = Synthetic
RDCAGYMRECKEKLRCSGYVCSSRWKWCVLPAPWRR

SEQ ID NO: 2287 - protein, 16 aa, synthetic construct
  REGION 1..16: note = Synthetic
KISDWWKRIWEKIKNK

SEQ ID NO: 2288 - protein, 18 aa, synthetic construct
  REGION 1..18: note = Synthetic
LQRFLELAYRVLRYLAKP

SEQ ID NO: 2289 - protein, 30 aa, synthetic construct
  REGION 1..30: note = Synthetic
TLNSFAQRLVRQWSSEGARLGLTYKEDKKR

SEQ ID NO: 2290 - protein, 25 aa, synthetic construct
  REGION 1..25: note = Synthetic
DMAQQCRDCCGGNGKCFGYQCLCNR

SEQ ID NO: 2291 - protein, 19 aa, synthetic construct
  REGION 1..19: note = Synthetic
KRMEYIAKKLDKMMEYESS

SEQ ID NO: 2292 - protein, 19 aa, synthetic construct
  REGION 1..19: note = Synthetic
NLINDGSTYFDRKKRFMSQ

SEQ ID NO: 2293 - protein, 17 aa, synthetic construct
  REGION 1..17: note = Synthetic
VQRVVEKFVKRAENQNP

SEQ ID NO: 2294 - protein, 17 aa, synthetic construct
  REGION 1..17: note = Synthetic
VQRVVEKFVKRAENQNP

SEQ ID NO: 2295 - protein, 37 aa, synthetic construct
  REGION 1..37: note = Synthetic
RKAIHELIQVMAELSPAAKTGKRKRSQMLFRGRRASQ

SEQ ID NO: 2296 - protein, 28 aa, synthetic construct
  REGION 1..28: note = Synthetic
LRNFLSDFDSLAQNVYKEYVHSMSGWID

SEQ ID NO: 2297 - protein, 18 aa, synthetic construct
  REGION 1..18: note = Synthetic
LQSFLELVHRVLRHLAQP

SEQ ID NO: 2298 - protein, 14 aa, synthetic construct
  REGION 1..14: note = Synthetic
EAVKKLLEALSHLV

SEQ ID NO: 2299 - protein, 14 aa, synthetic construct
  REGION 1..14: note = Synthetic
EAVKKLLEALSHLV

SEQ ID NO: 2300 - protein, 14 aa, synthetic construct
  REGION 1..14: note = Synthetic
EAVKKLLEALSHLV

SEQ ID NO: 2301 - protein, 14 aa, synthetic construct
  REGION 1..14: note = Synthetic
EAVKKLLEALSHLV

SEQ ID NO: 2302 - protein, 14 aa, synthetic construct
  REGION 1..14: note = Synthetic
EAVKKLLEALSHLV

SEQ ID NO: 2303 - protein, 14 aa, synthetic construct
  REGION 1..14: note = Synthetic
EAVKKLLEALSHLV

SEQ ID NO: 2304 - protein, 19 aa, synthetic construct
  REGION 1..19: note = Synthetic
KAIKNLLKAVSEKKSKRPP

SEQ ID NO: 2305 - protein, 17 aa, synthetic construct
  REGION 1..17: note = Synthetic
FLNTWITFCQSIISKLA

SEQ ID NO: 2306 - protein, 22 aa, synthetic construct
  REGION 1..22: note = Synthetic
DNVASAWNQAFDNIYEIIFRIV

SEQ ID NO: 2307 - protein, 23 aa, synthetic construct
  REGION 1..23: note = Synthetic
RGYNGCSRCCSYAGEAVQTQPGH

SEQ ID NO: 2308 - protein, 17 aa, synthetic construct
  REGION 1..17: note = Synthetic
FLNKWITFCQRIYSTMT

SEQ ID NO: 2309 - protein, 42 aa, synthetic construct
  REGION 1..42: note = Synthetic
RYGSDCAEPCKRLKCLLPSKCINGKCTCYPSIKIKNCKVQTY

SEQ ID NO: 2310 - protein, 34 aa, synthetic construct
  REGION 1..34: note = Synthetic
HNVISGLSEIAKSMSATAKPTKDRCAAYPYPDCP

SEQ ID NO: 2311 - protein, 11 aa, synthetic construct
  REGION 1..11: note = Synthetic
YDIIGNILKNF

SEQ ID NO: 2312 - protein, 28 aa, synthetic construct
  REGION 1..28: note = Synthetic
ITTCLTQLSEALTKGQPALIIAPMFRVG

SEQ ID NO: 2313 - protein, 12 aa, synthetic construct
  REGION 1..12: note = Synthetic
DNGKHWYDTGDQ

SEQ ID NO: 2314 - protein, 27 aa, synthetic construct
  REGION 1..27: note = Synthetic
FADCFYDAFSKIVDLKITIGTQWLIRS

SEQ ID NO: 2315 - protein, 35 aa, synthetic construct
  REGION 1..35: note = Synthetic
GLFRFARGYVEARTMWFDQKSGDATVEYSCYVLHY

SEQ ID NO: 2316 - protein, 22 aa, synthetic construct
  REGION 1..22: note = Synthetic
NQFLDYLQEFLGVMNTEWIIES

SEQ ID NO: 2317 - protein, 16 aa, synthetic construct
  REGION 1..16: note = Synthetic
LNKWITFCQRIFSTLT

SEQ ID NO: 2318 - protein, 13 aa, synthetic construct
  REGION 1..13: note = Synthetic
YSRGCSAITRCRS

SEQ ID NO: 2319 - protein, 11 aa, synthetic construct
  REGION 1..11: note = Synthetic
WRALDTLFENY

SEQ ID NO: 2320 - protein, 40 aa, synthetic construct
  REGION 1..40: note = Synthetic
VGNFVHGFSHVFGDDQQDNGKFYGYYAEDNGKHWYDTGDQ

SEQ ID NO: 2321 - protein, 42 aa, synthetic construct
  REGION 1..42: note = Synthetic
KAVEQVKSAFSKLQEKGVYKAMSEFDIFINYIETYMTMRMKI

SEQ ID NO: 2322 - protein, 12 aa, synthetic construct
  REGION 1..12: note = Synthetic
CGWVNRAWRGLV

SEQ ID NO: 2323 - protein, 16 aa, synthetic construct
  REGION 1..16: note = Synthetic
LNKWITFCQRIFSTLT

SEQ ID NO: 2324 - protein, 14 aa, synthetic construct
  REGION 1..14: note = Synthetic
HYGKKALQKASEKL

SEQ ID NO: 2325 - protein, 14 aa, synthetic construct
  REGION 1..14: note = Synthetic
HYGKKALQKASEKL

SEQ ID NO: 2326 - protein, 14 aa, synthetic construct
  REGION 1..14: note = Synthetic
HYGKKALQKASEKL

SEQ ID NO: 2327 - protein, 11 aa, synthetic construct
  REGION 1..11: note = Synthetic
INAISAIANHF

SEQ ID NO: 2328 - protein, 26 aa, synthetic construct
  REGION 1..26: note = Synthetic
DMAQQCRACCKGRGKCFGPQCLCGYD

SEQ ID NO: 2329 - protein, 15 aa, synthetic construct
  REGION 1..15: note = Synthetic
VQRIVQKILNKGKAN

SEQ ID NO: 2330 - protein, 37 aa, synthetic construct
  REGION 1..37: note = Synthetic
NCAKKIASGGNGMNAWVAWRNRCKGTDVHAWIRGCRL

SEQ ID NO: 2331 - protein, 14 aa, synthetic construct
  REGION 1..14: note = Synthetic
KALKALLGALTVFG

SEQ ID NO: 2332 - protein, 15 aa, synthetic construct
  REGION 1..15: note = Synthetic
ASKAFKDMVKAAHTD

SEQ ID NO: 2333 - protein, 34 aa, synthetic construct
  REGION 1..34: note = Synthetic
RACKGVFDACTPGKNECCPNRVCSDKHKWCKWKL

SEQ ID NO: 2334 - protein, 34 aa, synthetic construct
  REGION 1..34: note = Synthetic
KVEDALHTGAQAGFKLIRPVERGATPKKSEKPEK

SEQ ID NO: 2335 - protein, 11 aa, synthetic construct
  REGION 1..11: note = Synthetic
YASYGDSYDGI

SEQ ID NO: 2336 - protein, 22 aa, synthetic construct
  REGION 1..22: note = Synthetic
LTTLNDFLGRLRGIMQMKNWQG

SEQ ID NO: 2337 - protein, 42 aa, synthetic construct
  REGION 1..42: note = Synthetic
ITAAIQCAKRVVRDPQGIRAWVAWRAHCQNRDLSQYIRNCGV

SEQ ID NO: 2338 - protein, 28 aa, synthetic construct
  REGION 1..28: note = Synthetic
QYWTECCGRIGPHCSRCICPEVVCPKNG

SEQ ID NO: 2339 - protein, 20 aa, synthetic construct
  REGION 1..20: note = Synthetic
IRSLAHRWQTIIDQHGSYFQ

SEQ ID NO: 2340 - protein, 27 aa, synthetic construct
  REGION 1..27: note = Synthetic
SQCYKTCEKVVGVAAGKCMNGKCICYP

SEQ ID NO: 2341 - protein, 30 aa, synthetic construct
  REGION 1..30: note = Synthetic
FLSTVKNLATNVAGTVLDTIRCKVTGGCRP

SEQ ID NO: 2342 - protein, 18 aa, synthetic construct
  REGION 1..18: note = Synthetic
GGNCDGVMRQCKCIRQCW

SEQ ID NO: 2343 - protein, 14 aa, synthetic construct
  REGION 1..14: note = Synthetic
HYGKKALQKASEKL

SEQ ID NO: 2344 - protein, 14 aa, synthetic construct
  REGION 1..14: note = Synthetic
HYGKKALQKASEKL

SEQ ID NO: 2345 - protein, 21 aa, synthetic construct
  REGION 1..21: note = Synthetic
KAVEFLNKWITFCQSIYSTMT

SEQ ID NO: 2346 - protein, 23 aa, synthetic construct
  REGION 1..23: note = Synthetic
FSQARSCCSRLGRCCHVGKGYSG

SEQ ID NO: 2347 - protein, 35 aa, synthetic construct
  REGION 1..35: note = Synthetic
DLQSIVSQLLTRVNDNNSEAQHVRKQIFSRKFWKR

SEQ ID NO: 2348 - protein, 17 aa, synthetic construct
  REGION 1..17: note = Synthetic
MKKLLRYLNYVAEHTAV

SEQ ID NO: 2349 - protein, 17 aa, synthetic construct
  REGION 1..17: note = Synthetic
MKKLLRYLNYVAEHTAV

SEQ ID NO: 2350 - protein, 17 aa, synthetic construct
  REGION 1..17: note = Synthetic
MKKLLRYLNYVAEHTAV

SEQ ID NO: 2351 - protein, 17 aa, synthetic construct
  REGION 1..17: note = Synthetic
MKKLLRYLNYVAEHTAV

SEQ ID NO: 2352 - protein, 31 aa, synthetic construct
  REGION 1..31: note = Synthetic
EEVFKKFKKVAKSFGVPGKNLIMLSRSEPCS

SEQ ID NO: 2353 - protein, 22 aa, synthetic construct
  REGION 1..22: note = Synthetic
CARYYGNYFDYWGQGTTLTVSS

SEQ ID NO: 2354 - protein, 16 aa, synthetic construct
  REGION 1..16: note = Synthetic
SFVTRVLTTLTTIVDL

SEQ ID NO: 2355 - protein, 15 aa, synthetic construct
  REGION 1..15: note = Synthetic
VTKIATTVDQALSTS

SEQ ID NO: 2356 - protein, 32 aa, synthetic construct
  REGION 1..32: note = Synthetic
WFTMLKKLGTMALHAGKAALGAAANTISQGTQ

SEQ ID NO: 2357 - protein, 26 aa, synthetic construct
  REGION 1..26: note = Synthetic
GQCDDCCKKAGDRAGTCVYYKCKCNP

SEQ ID NO: 2358 - protein, 20 aa, synthetic construct
  REGION 1..20: note = Synthetic
ARSCCTRLGRCCHVAKGYSG

SEQ ID NO: 2359 - protein, 20 aa, synthetic construct
  REGION 1..20: note = Synthetic
ARSCCTRLGRCCHVAKGYSG

SEQ ID NO: 2360 - protein, 36 aa, synthetic construct
  REGION 1..36: note = Synthetic
SDASEIVNGASEQCAKGCSIFCTKSYVVPPGPPKLL

SEQ ID NO: 2361 - protein, 19 aa, synthetic construct
  REGION 1..19: note = Synthetic
VERVSACVDSCSNKCTKKN

SEQ ID NO: 2362 - protein, 24 aa, synthetic construct
  REGION 1..24: note = Synthetic
EDFETLLQQVARHARSECLFIFSG

SEQ ID NO: 2363 - protein, 42 aa, synthetic construct
  REGION 1..42: note = Synthetic
KAVEQVRGVFSKLQEKGVYKAMSEFDIFINYIEAYMTMKMKN

SEQ ID NO: 2364 - protein, 36 aa, synthetic construct
  REGION 1..36: note = Synthetic
ECDKAVATCFRDNLDTYKKRNIFHPTSSCVKVSTPC

SEQ ID NO: 2365 - protein, 36 aa, synthetic construct
  REGION 1..36: note = Synthetic
ECDKAVATCFRDNLDTYKKRNIFHPKSSCVKVSTPC

SEQ ID NO: 2366 - protein, 17 aa, synthetic construct
  REGION 1..17: note = Synthetic
LMDQLDEYANAVQIVGK

SEQ ID NO: 2367 - protein, 19 aa, synthetic construct
  REGION 1..19: note = Synthetic
NIQKCCSNGCGHVCKSPVF

SEQ ID NO: 2368 - protein, 23 aa, synthetic construct
  REGION 1..23: note = Synthetic
FLKRLLQEIKTCWNKILMGTKEH

SEQ ID NO: 2369 - protein, 26 aa, synthetic construct
  REGION 1..26: note = Synthetic
VGHCYGQFKDAKRCLCSVCGPDRQPP

SEQ ID NO: 2370 - protein, 23 aa, synthetic construct
  REGION 1..23: note = Synthetic
LPAIVGAAGKFLPKIFCAISKKC

SEQ ID NO: 2371 - protein, 29 aa, synthetic construct
  REGION 1..29: note = Synthetic
QEFLERMKSLLQKVSCFVLSLPIQIAFYI

SEQ ID NO: 2372 - protein, 22 aa, synthetic construct
  REGION 1..22: note = Synthetic
RHFLDYLQEFLGVMSTEWAMEV

SEQ ID NO: 2373 - protein, 20 aa, synthetic construct
  REGION 1..20: note = Synthetic
LAEQLMEKIKNLWYTKVQGY

SEQ ID NO: 2374 - protein, 20 aa, synthetic construct
  REGION 1..20: note = Synthetic
VAGVAGQVLKKIYCTISKKC

SEQ ID NO: 2375 - protein, 28 aa, synthetic construct
  REGION 1..28: note = Synthetic
KKLVEVMKDVASVCEMVRKKARMALKEY

SEQ ID NO: 2376 - protein, 35 aa, synthetic construct
  REGION 1..35: note = Synthetic
DLQSMVSQLLTRVNENNSDALHVRKQMFSRKFWKR

SEQ ID NO: 2377 - protein, 31 aa, synthetic construct
  REGION 1..31: note = Synthetic
DILDKMENAIHKAAQAGIGIAKPIEKMILPK

SEQ ID NO: 2378 - protein, 34 aa, synthetic construct
  REGION 1..34: note = Synthetic
DILDKMENAIHKAAQAGIGIAKPIENMILPKLTK

SEQ ID NO: 2379 - protein, 31 aa, synthetic construct; identical to SEQ ID NO: 2377
  REGION 1..31: note = Synthetic

SEQ ID NO: 2380 - protein, 34 aa, synthetic construct; identical to SEQ ID NO: 2378
  REGION 1..34: note = Synthetic

SEQ ID NO: 2381 - protein, 19 aa, synthetic construct
  REGION 1..19: note = Synthetic
FEQLIEKIKNLWYTRVLGY

SEQ ID NO: 2382 - protein, 20 aa, synthetic construct
  REGION 1..20: note = Synthetic
WAKYHAAVRHYVNLITRQRY

SEQ ID NO: 2383 - protein, 31 aa, synthetic construct
  REGION 1..31: note = Synthetic
AKSFVSTLGRAMENNPDDHHLYNDKDVPLDY

SEQ ID NO: 2384 - protein, 12 aa, synthetic construct
  REGION 1..12: note = Synthetic
FYGSYTGLGSSL

SEQ ID NO: 2385 - protein, 15 aa, synthetic construct
  REGION 1..15: note = Synthetic
DFLQQLTNLLRSMHK

SEQ ID NO: 2386 - protein, 21 aa, synthetic construct
  REGION 1..21: note = Synthetic
KAAEFLNKWITFCQSIYSTMT

SEQ ID NO: 2387 - protein, 33 aa, synthetic construct
  REGION 1..33: note = Synthetic
VKEAANVLESAWQMWHVNGTRCPKGVFPYDATQ

SEQ ID NO: 2388 - protein, 38 aa, synthetic construct
  REGION 1..38: note = Synthetic
QSLRRGCKRVPAQATAPFPDCCPTTLCRGRQWDRPRTL

SEQ ID NO: 2389 - protein, 31 aa, synthetic construct
  REGION 1..31: note = Synthetic
DSLYEPGKALASACQVAVEACAAWFPGPEKK

SEQ ID NO: 2390 - protein, 18 aa, synthetic construct
  REGION 1..18: note = Synthetic
KLVDSLLQVLKGKEGTAS

SEQ ID NO: 2391 - protein, 19 aa, synthetic construct
  REGION 1..19: note = Synthetic
EAIGKAAGKCMNGKCKCYP

SEQ ID NO: 2392 - protein, 28 aa, synthetic construct
  REGION 1..28: note = Synthetic
EQYSSLMEGLAGDLLQWMLHATRRERPQ

SEQ ID NO: 2393 - protein, 11 aa, synthetic construct
  REGION 1..11: note = Synthetic
INAISAIANHL

SEQ ID NO: 2394 - protein, 17 aa, synthetic construct
  REGION 1..17: note = Synthetic
FRRLCRNIKEVIKKNCY

SEQ ID NO: 2395 - protein, 36 aa, synthetic construct
  REGION 1..36: note = Synthetic
ECDRVAAECLRRSLSTYKYGYMFYPDSRCRGPSETC

SEQ ID NO: 2396 - protein, 36 aa, synthetic construct
  REGION 1..36: note = Synthetic
ECDRVAAECLRRSLSTYKNEYMFYPDSRCREPSETC

SEQ ID NO: 2397 - protein, 36 aa, synthetic construct; identical to SEQ ID NO: 2395
  REGION 1..36: note = Synthetic

SEQ ID NO: 2398 - protein, 17 aa, synthetic construct
  REGION 1..17: note = Synthetic
RDWDRVAERCPTAATWW

SEQ ID NO: 2399 - protein, 34 aa, synthetic construct
  REGION 1..34: note = Synthetic
NKLERVFRSLAYRVELLEANTEPMTEKKSVSVSE

SEQ ID NO: 2400 - protein, 21 aa, synthetic construct
  REGION 1..21: note = Synthetic
DDMNDYCTGISSDCPRNPWKD

SEQ ID NO: 2401 - protein, 20 aa, synthetic construct
  REGION 1..20: note = Synthetic
ARSCCTRLGRCCHVAKGYSG

SEQ ID NO: 2402 - protein, 33 aa, synthetic construct
  REGION 1..33: note = Synthetic
FGKRGLSDLDGLDELFDGEISKADRDFLRELMR

SEQ ID NO: 2403 - protein, 23 aa, synthetic construct
  REGION 1..23: note = Synthetic
EVANPVKGFFESPPTVGHNLVAD

SEQ ID NO: 2404 - protein, 20 aa, synthetic construct
  REGION 1..20: note = Synthetic
WAKYHAAVRHYVNLITRQRY

SEQ ID NO: 2405 - protein, 19 aa, synthetic construct
  REGION 1..19: note = Synthetic
SAMERLNNWLNTFKHQPHH

SEQ ID NO: 2406 - protein, 21 aa, synthetic construct
  REGION 1..21: note = Synthetic
KAVEFLNKWITFCQSIYSTMT

SEQ ID NO: 2407 - protein, 21 aa, synthetic construct
  REGION 1..21: note = Synthetic
KAVEFLNKWITFCQSIYSTLT

SEQ ID NO: 2408 - protein, 12 aa, synthetic construct
  REGION 1..12: note = Synthetic
DNGKHWYDTGDQ

SEQ ID NO: 2409 - protein, 40 aa, synthetic construct
  REGION 1..40: note = Synthetic
YYDTFTKLCNTFQHTGCGGNSNHFKEWNDCFFTCGSGFEW

SEQ ID NO: 2410 - protein, 11 aa, synthetic construct
  REGION 1..11: note = Synthetic
TCVSSIVRHAS

SEQ ID NO: 2411 - protein, 12 aa, synthetic construct
  REGION 1..12: note = Synthetic
FFHRISHFLESA

SEQ ID NO: 2412 - protein, 24 aa, synthetic construct
  REGION 1..24: note = Synthetic
LFNDLEHVCDDCYNLYRTSYVASA

SEQ ID NO: 2413 - protein, 24 aa, synthetic construct
  REGION 1..24: note = Synthetic
YKSGARIGRNCFCLLKGVIYKREN

SEQ ID NO: 2414 - protein, 27 aa, synthetic construct
  REGION 1..27: note = Synthetic
DLTRALHDLVKALKKAYRTLDIAAVEH

SEQ ID NO: 2415 - protein, 20 aa, synthetic construct
  REGION 1..20: note = Synthetic
LDHMHDLLSTLQKLKFANNK

SEQ ID NO: 2416 - protein, 19 aa, synthetic construct
  REGION 1..19: note = Synthetic
EAIGKSAGKCMNGKCKCYP

SEQ ID NO: 2417 - protein, 26 aa, synthetic construct
  REGION 1..26: note = Synthetic
INGLYNIVKHVNTLVFKRFNEGLTYS

SEQ ID NO: 2418 - protein, 15 aa, synthetic construct
  REGION 1..15: note = Synthetic
LKTLFTTIWKFIKKD

SEQ ID NO: 2419 - protein, 30 aa, synthetic construct
  REGION 1..30: note = Synthetic
FLSTVKNLATNVAGTVIDTLKCKVTGGCRS

SEQ ID NO: 2420 - protein, 26 aa, synthetic construct
  REGION 1..26: note = Synthetic
GQCDECCKKAGDRAGTCVYYKCKCNP

SEQ ID NO: 2421 - protein, 26 aa, synthetic construct
  REGION 1..26: note = Synthetic
GQCDECCKKAGDRAGTCVYYKCKCNP

SEQ ID NO: 2422 - protein, 16 aa, synthetic construct
  REGION 1..16: note = Synthetic
DKIKDAATGFVTGIQS

SEQ ID NO: 2423 - protein, 32 aa, synthetic construct
  REGION 1..32: note = Synthetic
VCQRFCKNLTYIFNNRTYTHKCCNSDFCNFRL

SEQ ID NO: 2424 - protein, 23 aa, synthetic construct
  REGION 1..23: note = Synthetic
LPAIVGAAAKFLPKIFCVISKKC

SEQ ID NO: 2425 - protein, 23 aa, synthetic construct
  REGION 1..23: note = Synthetic
FSQARSYCSRLGRCCHVGKGYSG

SEQ ID NO: 2426 - protein, 23 aa, synthetic construct
  REGION 1..23: note = Synthetic
WSKIKEAAKTAGKAAMGFVNEMV

SEQ ID NO: 2427 - protein, 30 aa, synthetic construct
  REGION 1..30: note = Synthetic
GDAKAAWKELNKNFNSEAQHQLEKLGLPHA

SEQ ID NO: 2428 - protein, 26 aa, synthetic construct
  REGION 1..26: note = Synthetic
GQCDECCKKAGDRAGTCVYYKCKCNP

SEQ ID NO: 2429 - protein, 16 aa, synthetic construct
  REGION 1..16: note = Synthetic
DKFKDAATGFVTGIQS

SEQ ID NO: 2430 - protein, 31 aa, synthetic construct
  REGION 1..31: note = Synthetic
HTLLKILSTFLYQLFSSSIVVALFTLVPYSI

SEQ ID NO: 2431 - protein, 34 aa, synthetic construct
  REGION 1..34: note = Synthetic
HTLLKILSTFLYQLFSSSIVVAIFTLIPYLIFGA

SEQ ID NO: 2432 - protein, 41 aa, synthetic construct
  REGION 1..41: note = Synthetic
SVCDNMDNVFRGQEMKFDMGLCSNACARFCNDGAVIQSVEA

SEQ ID NO: 2433 - protein, 25 aa, synthetic construct
  REGION 1..25: note = Synthetic
SPIKRIIRDVKEIVRARNGLQFSLF

SEQ ID NO: 2434 - protein, 18 aa, synthetic construct
  REGION 1..18: note = Synthetic
LQSFLELVHRVLRHLAQP

SEQ ID NO: 2435 - protein, 18 aa, synthetic construct
  REGION 1..18: note = Synthetic
KTADTFATKLVQCVKDNL

SEQ ID NO: 2436 - protein, 42 aa, synthetic construct
  REGION 1..42: note = Synthetic
ITQAIQCAKRVVRDPQGIRAWVAWQRHCQNRDLSGYIRNCGV

SEQ ID NO: 2437 - protein, 11 aa, synthetic construct
  REGION 1..11: note = Synthetic
IDEVEDWIASY

SEQ ID NO: 2438 - protein, 42 aa, synthetic construct
  REGION 1..42: note = Synthetic
KAVEQVKSVFSKLQERGVYKAMSEFDIFINYIETYTTMKMKN

SEQ ID NO: 2439 - protein, 13 aa, synthetic construct
  REGION 1..13: note = Synthetic
GGRCVNTICNCRN

SEQ ID NO: 2440 - protein, 15 aa, synthetic construct
  REGION 1..15: note = Synthetic
DFLHELTNFVRYLQK

SEQ ID NO: 2441 - protein, 15 aa, synthetic construct
  REGION 1..15: note = Synthetic
DFLHELTNFVRYLQK

SEQ ID NO: 2442 - protein, 15 aa, synthetic construct
  REGION 1..15: note = Synthetic
DFLHELTNFVRYLQK

SEQ ID NO: 2443 - protein, 15 aa, synthetic construct
  REGION 1..15: note = Synthetic
DFLHELTNFVRYLQK

SEQ ID NO: 2444 - protein, 29 aa, synthetic construct
  REGION 1..29: note = Synthetic
CNDMCSRMARGCQHFTFCTRPGQCCCWFT

SEQ ID NO: 2445 - protein, 41 aa, synthetic construct
  REGION 1..41: note = Synthetic
DYYGDLAARLGYFPSSIVREDQTLKPGKVDVKTDKWDFYCQ

SEQ ID NO: 2446 - protein, 14 aa, synthetic construct
  REGION 1..14: note = Synthetic
EKFKRIANSFLQKN

SEQ ID NO: 2447 - protein, 21 aa, synthetic construct
  REGION 1..21: note = Synthetic
DFINNMYTVFEEFTEMITNLP

SEQ ID NO: 2448 - protein, 16 aa, synthetic construct
  REGION 1..16: note = Synthetic
VDEVFDEVVQIFDKEG

SEQ ID NO: 2449 - protein, 30 aa, synthetic construct
  REGION 1..30: note = Synthetic
GLAGAISSVLDKLKQSQLIKNYAKKLGYPR

SEQ ID NO: 2450 - protein, 20 aa, synthetic construct
  REGION 1..20: note = Synthetic
KVISKGASMCKVLFDKKKQE

SEQ ID NO: 2451 - protein, 30 aa, synthetic construct
  REGION 1..30: note = Synthetic
MSSVYGNGKSILRGILRNGVCCGYKLCHPC

SEQ ID NO: 2452 - protein, 34 aa, synthetic construct
  REGION 1..34: note = Synthetic
CAEPCGNFCHKASDKPGGRRVDPNASCKTGYVYW

SEQ ID NO: 2453 - protein, 34 aa, synthetic construct; identical to SEQ ID NO: 2452
  REGION 1..34: note = Synthetic

SEQ ID NO: 2454 - protein, 30 aa, synthetic construct
  REGION 1..30: note = Synthetic
WTEYLKWYNHICDFTLPFICKFLAEPDDPE

SEQ ID NO: 2455 - protein, 40 aa, synthetic construct
  REGION 1..40: note = Synthetic
YYDTFTKLCNTFQHTGCGGNSNHFKDWNDCFFTCGNGFET

SEQ ID NO: 2456 - protein, 28 aa, synthetic construct
  REGION 1..28: note = Synthetic
KHAHSMITSMLTFVSSVMNFGRSFVKDQ

SEQ ID NO: 2457 - protein, 28 aa, synthetic construct
  REGION 1..28: note = Synthetic
KHAHSMITSMLTFVSSVMNFGRSFVKDQ

SEQ ID NO: 2458 - protein, 22 aa, synthetic construct
  REGION 1..22: note = Synthetic
IKRFSTLWRDIWQVASNFRHYE

SEQ ID NO: 2459 - protein, 21 aa, synthetic construct
  REGION 1..21: note = Synthetic
LEDLEDLVTRAIYEFDLDELL

SEQ ID NO: 2460 - protein, 19 aa, synthetic construct
  REGION 1..19: note = Synthetic
KTIKNLMKAFSQKRSKRAP

SEQ ID NO: 2461 - protein, 31 aa, synthetic construct
  REGION 1..31: note = Synthetic
AKGRELLKDYANRVINGGPEEEAAVPAERRR

SEQ ID NO: 2462 - protein, 29 aa, synthetic construct
  REGION 1..29: note = Synthetic
KQCLKPCKDLYGPHAGAKCMNGKCKCYNN

SEQ ID NO: 2463 - protein, 29 aa, synthetic construct
  REGION 1..29: note = Synthetic
KQCLKPCKDLYGPHAGAKCMNGKCKCYNN

SEQ ID NO: 2464 - protein, 17 aa, synthetic construct
  REGION 1..17: note = Synthetic
LFDVIKKVASVIGLASQ

SEQ ID NO: 2465 - protein, 16 aa, synthetic construct
  REGION 1..16: note = Synthetic
LARRMNEVFKEMLRPQ

SEQ ID NO: 2466 - protein, 25 aa, synthetic construct
  REGION 1..25: note = Synthetic
GDCCRYGERCISTGVNYYCRPDFGP

SEQ ID NO: 2467 - protein, 15 aa, synthetic construct
  REGION 1..15: note = Synthetic
YCRFGNTIYGLCCRR

SEQ ID NO: 2468 - protein, 24 aa, synthetic construct
  REGION 1..24: note = Synthetic
DDYTKCCKSFDAFITCGFLLSKES

SEQ ID NO: 2469 - protein, 13 aa, synthetic construct
  REGION 1..13: note = Synthetic
KWVQEYINYLELK

SEQ ID NO: 2470 - protein, 26 aa, synthetic construct
  REGION 1..26: note = Synthetic
EDMSELIERAYTVAYERVYPPTSSKK

SEQ ID NO: 2471 - protein, 25 aa, synthetic construct
  REGION 1..25: note = Synthetic
GDCCRYGERCISTGVNYYCKPDFGP

SEQ ID NO: 2472 - protein, 16 aa, synthetic construct
  REGION 1..16: note = Synthetic
DKLKDAATGFVTGIQS

SEQ ID NO: 2473 - protein, 15 aa, synthetic construct
  REGION 1..15: note = Synthetic
KYIEKVVDKAKTVVG

SEQ ID NO: 2474 - protein, 19 aa, synthetic construct
  REGION 1..19: note = Synthetic
QAIGKAAGKCMNGKCKCYP

SEQ ID NO: 2475 - protein, 14 aa, synthetic construct
  REGION 1..14: note = Synthetic
KCCRTIQTCGNTTD

SEQ ID NO: 2476 - protein, 28 aa, synthetic construct
  REGION 1..28: note = Synthetic
SSIIYNIGKFFSYLLSHQSSSLLQRESL

SEQ ID NO: 2477 - protein, 32 aa, synthetic construct
  REGION 1..32: note = Synthetic
CSLLQEAFQRFSTCAGTSVFPQGQKSLGSITR

SEQ ID NO: 2478 - protein, 19 aa, synthetic construct
  REGION 1..19: note = Synthetic
NVYSRGCTTINRCRRVQNP

SEQ ID NO: 2479 - protein, 40 aa, synthetic construct; identical to SEQ ID NO: 2259
  REGION 1..40: note = Synthetic

SEQ ID NO: 2480 - protein, 20 aa, synthetic construct
  REGION 1..20: note = Synthetic
NKIETIAKNALRGLRDVTHL

SEQ ID NO: 2481 - protein, 24 aa, synthetic construct
  REGION 1..24: note = Synthetic
LSTLQTAVTQLANSLGTVVGQISG

SEQ ID NO: 2482 - protein, 14 aa, synthetic construct
  REGION 1..14: note = Synthetic
EKFTRIANSFLQKN

SEQ ID NO: 2483 - protein, 32 aa, synthetic construct
  REGION 1..32: note = Synthetic
FGKRGLSDLSDLDELFDGEITKADLDLLREIM

SEQ ID NO: 2484 - protein, 27 aa, synthetic construct
  REGION 1..27: note = Synthetic
QLWKGIGKCIKTDDHKLLCLCKYECIV

SEQ ID NO: 2485 - protein, 35 aa, synthetic construct
  REGION 1..35: note = Synthetic
ACQGYMRKCGRDKPPCCKKLECSKTWRWCVWNPWE

SEQ ID NO: 2486 - protein, 35 aa, synthetic construct
  REGION 1..35: note = Synthetic
RRCKYVLESAARAAQVAASVNAAARAGDRVAARAS

SEQ ID NO: 2487 - protein, 22 aa, synthetic construct
  REGION 1..22: note = Synthetic
NWGEGIMGICKKRYGSPILCCR

SEQ ID NO: 2488 - protein, 41 aa, synthetic construct
  REGION 1..41: note = Synthetic
LKQILQRWGEECRACAEKSDYVNLIRELAPKYVEIYPQTEL

SEQ ID NO: 2489 - protein, 11 aa, synthetic construct
  REGION 1..11: note = Synthetic
MTQGQHFLQKV

SEQ ID NO: 2490 - protein, 28 aa, synthetic construct
  REGION 1..28: note = Synthetic
IKRLASTAFSMANHIEHTFRKNSNKKDD

SEQ ID NO: 2491 - protein, 20 aa, synthetic construct
  REGION 1..20: note = Synthetic
RLHNVVGTCYEGKGKCCHKN

SEQ ID NO: 2492 - protein, 42 aa, synthetic construct
  REGION 1..42: note = Synthetic
CLRACNSCCSRCNCVPPGTSGNTHLCPCYASITTHGGRLKCP

SEQ ID NO: 2493 - protein, 14 aa, synthetic construct
  REGION 1..14: note = Synthetic
NDLCSHIDEAFRYL

SEQ ID NO: 2494 - protein, 36 aa, synthetic construct
  REGION 1..36: note = Synthetic
RKAVHELIQVMAELSPAAKIGKRKRSQMFRGRRASQ

SEQ ID NO: 2495 - protein, 19 aa, synthetic construct
  REGION 1..19: note = Synthetic
FEQLIEKIKNMWYTRVLGY

SEQ ID NO: 2496 - protein, 14 aa, synthetic construct
  REGION 1..14: note = Synthetic
FADLFGKAVDFIKS

SEQ ID NO: 2497 - protein, 41 aa, synthetic construct; identical to SEQ ID NO: 2432
  REGION 1..41: note = Synthetic

SEQ ID NO: 2498 - protein, 22 aa, synthetic construct
  REGION 1..22: note = Synthetic
ATKAGRRVINARRRKGRAKLTV

SEQ ID NO: 2499 - protein, 36 aa, synthetic construct
  REGION 1..36: note = Synthetic
ASQALKRGCKSVPGPAGKRFPECCPTTLCRGKQWGQ

SEQ ID NO: 2500 - protein, 24 aa, synthetic construct
  REGION 1..24: note = Synthetic
RGCRRCCSYLGEAMDAETQADPHN

SEQ ID NO: 2501 - protein, 42 aa, synthetic construct
  REGION 1..42: note = Synthetic
KAVEQVKSAFSKLQEKGVYKAMSEFDIFINYIEAYMTTKMKN

SEQ ID NO: 2502 - protein, 35 aa, synthetic construct
  REGION 1..35: note = Synthetic
TCMKDFVKKGGVMNKPISCECDNLGYEHLCRCNFS

SEQ ID NO: 2503 - protein, 29 aa, synthetic construct
  REGION 1..29: note = Synthetic
VSEVQNCMRSLNNLMMLTGERGGFLEKKW

SEQ ID NO: 2504 - protein, 17 aa, synthetic construct
  REGION 1..17: note = Synthetic
FQRFLETAYRALRHLAR

SEQ ID NO: 2505 - protein, 36 aa, synthetic construct; identical to SEQ ID NO: 2494
  REGION 1..36: note = Synthetic

SEQ ID NO: 2506 - protein, 36 aa, synthetic construct
  REGION 1..36: note = Synthetic
RKAVHELIQVMAELSPAAKIGKRKRSQTFRGRRASQ

SEQ ID NO: 2507 - protein, 36 aa, synthetic construct; identical to SEQ ID NO: 2494
  REGION 1..36: note = Synthetic

SEQ ID NO: 2508 - protein, 36 aa, synthetic construct; identical to SEQ ID NO: 2494
  REGION 1..36: note = Synthetic

SEQ ID NO: 2509 - protein, 28 aa, synthetic construct
  REGION 1..28: note = Synthetic
ITDALKGAAKTVAAELLRKAHCKLTNSC

SEQ ID NO: 2510 - protein, 42 aa, synthetic construct; identical to SEQ ID NO: 2321
  REGION 1..42: note = Synthetic

SEQ ID NO: 2511 - protein, 19 aa, synthetic construct
  REGION 1..19: note = Synthetic
VDQVIEKMKNLCYKNFVGY

SEQ ID NO: 2512 - protein, 22 aa, synthetic construct
  REGION 1..22: note = Synthetic
CSRGMRDCCTSCLLYSNKCRRY

SEQ ID NO: 2513 - protein, 24 aa, synthetic construct
  REGION 1..24: note = Synthetic
RHLARTLLTAAREPRPAPPSSNKV

SEQ ID NO: 2514 - protein, 30 aa, synthetic construct
  REGION 1..30: note = Synthetic
QNLHTIITRICYRVRTSQTWPLFPLACASM

SEQ ID NO: 2515 - protein, 15 aa, synthetic construct
  REGION 1..15: note = Synthetic
ITEFLNKWITFCQSI

SEQ ID NO: 2516 - protein, 25 aa, synthetic construct
  REGION 1..25: note = Synthetic
QECTDCCKKYGHNGGTCMFFKCKCA

SEQ ID NO: 2517 - protein, 22 aa, synthetic construct
  REGION 1..22: note = Synthetic
GMATKAGTALGKVAKAVIGAAL

SEQ ID NO: 2518 - protein, 21 aa, synthetic construct
  REGION 1..21: note = Synthetic
GLLSKVLGVGKKVLCGVSGLC

SEQ ID NO: 2519 - protein, 21 aa, synthetic construct
  REGION 1..21: note = Synthetic
DDMNDYCTGISSDCPRNPYKD

SEQ ID NO: 2520 - protein, 25 aa, synthetic construct
  REGION 1..25: note = Synthetic
QECTDCCKKYGHNGGTCMFFKCKCA

SEQ ID NO: 2521 - protein, 42 aa, synthetic construct
  REGION 1..42: note = Synthetic
IADAVTCAKRVVRDPQGIRAWVAWRNHCQNRDVSQYVQGCGV

SEQ ID NO: 2522 - protein, 42 aa, synthetic construct; identical to SEQ ID NO: 2521
  REGION 1..42: note = Synthetic

SEQ ID NO: 2523 - protein, 42 aa, synthetic construct; identical to SEQ ID NO: 2521
  REGION 1..42: note = Synthetic

SEQ ID NO: 2524 - protein, 19 aa, synthetic construct
  REGION 1..19: note = Synthetic
WDYIAHDLLHKVKSISTCK

SEQ ID NO: 2525 - protein, 20 aa, synthetic construct
  REGION 1..20: note = Synthetic
SRLDSFIQKAISKLRSSAAN

SEQ ID NO: 2526 - protein, 30 aa, synthetic construct
  REGION 1..30: note = Synthetic
AKWLQRLLRHVQSKSLSSTPQAPVSKRRAA

SEQ ID NO: 2527 - protein, 19 aa, synthetic construct
  REGION 1..19: note = Synthetic
IKGLLGSVTEAKNGYRTYK

SEQ ID NO: 2528 - protein, 36 aa, synthetic construct
  REGION 1..36: note = Synthetic
ARLGRQVDSMWAEQKQMELESILVALLQKHSRNSQG

SEQ ID NO: 2529 - protein, 42 aa, synthetic construct
  REGION 1..42: note = Synthetic
GLYRNLSSMANKTCSMNEIKKSTLKDFLERLKVIMQKKYYRH

SEQ ID NO: 2530 - protein, 37 aa, synthetic construct
  REGION 1..37: note = Synthetic
KAVNELFKVMNGDLSPKSNLRKRKRSQSTFHGRRASI

SEQ ID NO: 2531 - protein, 12 aa, synthetic construct
  REGION 1..12: note = Synthetic
CGWVNRAWRGLV

SEQ ID NO: 2532 - protein, 12 aa, synthetic construct
  REGION 1..12: note = Synthetic
CGWVNRAWRGLV

SEQ ID NO: 2533 - protein, 12 aa, synthetic construct
  REGION 1..12: note = Synthetic
CGWVNRAWRGLV

SEQ ID NO: 2534 - protein, 26 aa, synthetic construct
  REGION 1..26: note = Synthetic
WAQSLISLFQALRHDLMRSSSPAVSS

SEQ ID NO: 2535 - protein, 34 aa, synthetic construct
  REGION 1..34: note = Synthetic
CAEPCGNFCHKASDKPGGRRVDPNASCQTGYVYW

SEQ ID NO: 2536 - protein, 34 aa, synthetic construct; identical to SEQ ID NO: 2535
  REGION 1..34: note = Synthetic

SEQ ID NO: 2537 - protein, 34 aa, synthetic construct; identical to SEQ ID NO: 2535
  REGION 1..34: note = Synthetic

SEQ ID NO: 2538 - protein, 34 aa, synthetic construct; identical to SEQ ID NO: 2535
  REGION 1..34: note = Synthetic

SEQ ID NO: 2539 - protein, 35 aa, synthetic construct
  REGION 1..35: note = Synthetic
LAKVANTLISDISELKDKVQNVSGYTISSALQNIG

SEQ ID NO: 2540 - protein, 12 aa, synthetic construct
  REGION 1..12: note = Synthetic
IYGSYSGVGSSL

SEQ ID NO: 2541 - protein, 12 aa, synthetic construct
  REGION 1..12: note = Synthetic
IYGSYSGVGSSL

SEQ ID NO: 2542 - protein, 38 aa, synthetic construct
  REGION 1..38: note = Synthetic
RECTKLLGGCTKDSECCPHLGCRKKWPYHCGWDGTFGK

SEQ ID NO: 2543 - protein, 14 aa, synthetic construct
  REGION 1..14: note = Synthetic
WYEWINRCSNLLED

SEQ ID NO: 2544 - protein, 23 aa, synthetic construct
  REGION 1..23: note = Synthetic
IYTMCEIASDACQNWFPTSVEKK

SEQ ID NO: 2545 - protein, 28 aa, synthetic construct
  REGION 1..28: note = Synthetic
SQLLKVLHKIWTQVPCHLNSDGTNALHF

SEQ ID NO: 2546 - protein, 35 aa, synthetic construct
  REGION 1..35: note = Synthetic
SVFKEYAGSMGESCGGLWLAILLLLASIAAGLSLS

SEQ ID NO: 2547 - protein, 12 aa, synthetic construct
  REGION 1..12: note = Synthetic
FYGSYSGVGSSL

SEQ ID NO: 2548 - protein, 21 aa, synthetic construct
  REGION 1..21: note = Synthetic
MGGLAGDLLRILHATSRGRPQ

SEQ ID NO: 2549 - protein, 29 aa, synthetic construct
  REGION 1..29: note = Synthetic
HLIRAIRTVMTFPLIAINTIVIVYNLVLG

SEQ ID NO: 2550 - protein, 14 aa, synthetic construct
  REGION 1..14: note = Synthetic
IGHLIKTALGFLGL

SEQ ID NO: 2551 - protein, 11 aa, synthetic construct
  REGION 1..11: note = Synthetic
ELVSGIVEGVK

SEQ ID NO: 2552 - protein, 11 aa, synthetic construct
  REGION 1..11: note = Synthetic
ELVSGIVEGVK

SEQ ID NO: 2553 - protein, 11 aa, synthetic construct
  REGION 1..11: note = Synthetic
ELVSGIVEGVK

SEQ ID NO: 2554 - protein, 11 aa, synthetic construct
  REGION 1..11: note = Synthetic
ELVSGIVEGVK

SEQ ID NO: 2555 - protein, 26 aa, synthetic construct
  REGION 1..26: note = Synthetic
CKAAGKPCSRIAYNCCTGSCRSGKCG

SEQ ID NO: 2556 - protein, 36 aa, synthetic construct; identical to SEQ ID NO: 2494
  REGION 1..36: note = Synthetic

SEQ ID NO: 2557 - protein, 35 aa, synthetic construct
  REGION 1..35: note = Synthetic
ECDKAVATCFRDNLDTYNKKQQFNTGIFCSKAKAC

SEQ ID NO: 2558 - protein, 32 aa, synthetic construct
  REGION 1..32: note = Synthetic
FIKGAKNIGKEVGMDVIRTGIDVAGCKIKGEC

SEQ ID NO: 2559 - protein, 25 aa, synthetic construct
  REGION 1..25: note = Synthetic
ADCCRYGERCISTGVNYYCRPDFGP

SEQ ID NO: 2560 - protein, 21 aa, synthetic construct
  REGION 1..21: note = Synthetic
KAVEFLNKWITFCQRIYSTMT

SEQ ID NO: 2561 - protein, 24 aa, synthetic construct
  REGION 1..24: note = Synthetic
KGFNDLVDNINKAFSNLKPENAKQ

SEQ ID NO: 2562 - protein, 33 aa, synthetic construct
  REGION 1..33: note = Synthetic
FYGECVECLNSGERCWRNSECCSGYCRWFTCQD

SEQ ID NO: 2563 - protein, 34 aa, synthetic construct
  REGION 1..34: note = Synthetic
GKEYDSCIKEGSVFSKYWCPVTPNYDQDRAWRYC

SEQ ID NO: 2564 - protein, 12 aa, synthetic construct
  REGION 1..12: note = Synthetic
GQAVLNSASEAL

SEQ ID NO: 2565 - protein, 19 aa, synthetic construct
  REGION 1..19: note = Synthetic
NPWTEACHEIRSCFSCARV

SEQ ID NO: 2566 - protein, 36 aa, synthetic construct
  REGION 1..36: note = Synthetic
ECDRVAAECLRRSLSTYKYGYMFYLDSRCKGPSEQC

SEQ ID NO: 2567 - protein, 32 aa, synthetic construct
  REGION 1..32: note = Synthetic
LLDSLKGFAATAGKGVLQSLLSTASCKLAKTC

SEQ ID NO: 2568 - protein, 38 aa, synthetic construct
  REGION 1..38: note = Synthetic
RACREWLGGCSKDADCCAHLECRKKWPYHCVWDWTVRK

SEQ ID NO: 2569 - protein, 27 aa, synthetic construct
  REGION 1..27: note = Synthetic
MLDGLNDYCTGVTSDCPRNPYKGKEDD

SEQ ID NO: 2570 - protein, 17 aa, synthetic construct
  REGION 1..17: note = Synthetic
KWIQEYLEKALNKKVKT

SEQ ID NO: 2571 - protein, 18 aa, synthetic construct
  REGION 1..18: note = Synthetic
LQSFLEVAYRALRHFTKP

SEQ ID NO: 2572 - protein, 37 aa, synthetic construct
  REGION 1..37: note = Synthetic
GRGCKGFGDSCTPGKNECCPNHACSNKHKWCKVYLGK

SEQ ID NO: 2573 - protein, 15 aa, synthetic construct
  REGION 1..15: note = Synthetic
ILGIITSLLKSLGKK

SEQ ID NO: 2574 - protein, 19 aa, synthetic construct
  REGION 1..19: note = Synthetic
RACQQFLKRCHLASFALPL

SEQ ID NO: 2575 - protein, 35 aa, synthetic construct
  REGION 1..35: note = Synthetic
RLGRQVDSMWADHRQMSLESLLAALLQKHSRDSQG

SEQ ID NO: 2576 - protein, 29 aa, synthetic construct
  REGION 1..29: note = Synthetic
SLADQAANKWGRSGRDPNHFRPAGLPEKY

SEQ ID NO: 2577 - protein, 27 aa, synthetic construct
  REGION 1..27: note = Synthetic
EHIQHLFDSMLRRLEAFIAAHGGCTKY

SEQ ID NO: 2578 - protein, 25 aa, synthetic construct
  REGION 1..25: note = Synthetic
CDSAKKILDEVEKLAEAEGVTGKTR

SEQ ID NO: 2579 - protein, 33 aa, synthetic construct
  REGION 1..33: note = Synthetic
DRASKVIQEAKNLPPRCNQGPPCNIPGTIGYYW

SEQ ID NO: 2580 - protein, 17 aa, synthetic construct
  REGION 1..17: note = Synthetic
GDALYNEIKTWPHWRQN

SEQ ID NO: 2581 - protein, 31 aa, synthetic construct
  REGION 1..31: note = Synthetic
FDKIREFIQYLHEIAEEVGIDDNQMSNIKIT

SEQ ID NO: 2582 - protein, 28 aa, synthetic construct
  REGION 1..28: note = Synthetic
SSVNDIGDDWKATRVGINIFTRLRTQKE

SEQ ID NO: 2583 - protein, 17 aa, synthetic construct
  REGION 1..17: note = Synthetic
FLNKWITFCQSIYSTMT

SEQ ID NO: 2584 - protein, 22 aa, synthetic construct
  REGION 1..22: note = Synthetic
TIVEFLNRWITFCQSIISASSS

SEQ ID NO: 2585 - protein, 22 aa, synthetic construct
  REGION 1..22: note = Synthetic
TIVEFLNRWITFCQSIISASSS

SEQ ID NO: 2586 - protein, 22 aa, synthetic construct
  REGION 1..22: note = Synthetic
TIVEFLNRWITFCQSIISASSS

SEQ ID NO: 2587 - protein, 33 aa, synthetic construct
  REGION 1..33: note = Synthetic
SWLSTVLTTLYSMWLSFPLTHKVKPDLVLCNGP

SEQ ID NO: 2588 - protein, 17 aa, synthetic construct
  REGION 1..17: note = Synthetic
FLNKWITFCQSIYSTMT

SEQ ID NO: 2589 - protein, 17 aa, synthetic construct
  REGION 1..17: note = Synthetic
FLNKWITFCQSIYSTMT

SEQ ID NO: 2590 - protein, 20 aa, synthetic construct
  REGION 1..20: note = Synthetic
IDVITDALTRAEECAKRGSN

SEQ ID NO: 2591 - protein, 26 aa, synthetic construct
  REGION 1..26: note = Synthetic
WIAYCNNIMSCCRKDTDFVLPQTKGI

SEQ ID NO: 2592 - protein, 32 aa, synthetic construct
  REGION 1..32: note = Synthetic
LISGLKSVGKEVGMDVVRTGIDIAGCKIKGEC

SEQ ID NO: 2593 - protein, 30 aa, synthetic construct
  REGION 1..30: note = Synthetic
VMSSCKTIVQTLLNNSTGTFIAPPSKPSSL

SEQ ID NO: 2594 - protein, 14 aa, synthetic construct
  REGION 1..14: note = Synthetic
KWVQKYISDLKLNA

SEQ ID NO: 2595 - protein, 20 aa, synthetic construct
  REGION 1..20: note = Synthetic
SIAKTLAKSVSHVLCISKTQ

SEQ ID NO: 2596 - protein, 38 aa, synthetic construct
  REGION 1..38: note = Synthetic
NGAVSGYCQWLGKYGNACWCINLPDKVPIRIPGACRGR

SEQ ID NO: 2597 - protein, 12 aa, synthetic construct
  REGION 1..12: note = Synthetic
CGWVSRAWRGLV

SEQ ID NO: 2598 - protein, 19 aa, synthetic construct
  REGION 1..19: note = Synthetic
ISDILRIASTALQKLALQC

SEQ ID NO: 2599 - protein, 24 aa, synthetic construct
  REGION 1..24: note = Synthetic
RRVKQFLDYLQEFLTVINTEWTME

SEQ ID NO: 2600 - protein, 31 aa, synthetic construct
  REGION 1..31: note = Synthetic
RNAREILQRLETIAQDPRMCEICAFAACAGC

SEQ ID NO: 2601 - protein, 19 aa, synthetic construct
  REGION 1..19: note = Synthetic
KTADTFATKLVQCVKDNLI

SEQ ID NO: 2602 - protein, 17 aa, synthetic construct
  REGION 1..17: note = Synthetic
LFDIIKKVASVVGLASQ

SEQ ID NO: 2603 - protein, 26 aa, synthetic construct
  REGION 1..26: note = Synthetic
SQFHQLVNRCIHGVQAARPGFGRWRG

SEQ ID NO: 2604 - protein, 35 aa, synthetic construct
  REGION 1..35: note = Synthetic
LTQAFKDMVKVVNQVLNSDTATYNAIFDKYFLPEH

SEQ ID NO: 2605 - protein, 19 aa, synthetic construct
  REGION 1..19: note = Synthetic
TSLKDFLESLKSIMQMDYS

SEQ ID NO: 2606 - protein, 14 aa, synthetic construct
  REGION 1..14: note = Synthetic
IQFYKKIIANGYAK

SEQ ID NO: 2607 - protein, 12 aa, synthetic construct
  REGION 1..12: note = Synthetic
CGWVGRAWKGLV

SEQ ID NO: 2608 - protein, 21 aa, synthetic construct
  REGION 1..21: note = Synthetic
EEIHKVIKQAIEWLKELDLDL

SEQ ID NO: 2609 - protein, 35 aa, synthetic construct
  REGION 1..35: note = Synthetic
RMVNDFYKAFRDLDRCQEYCNWRVERDGVFGYNDK

SEQ ID NO: 2610 - protein, 23 aa, synthetic construct
  REGION 1..23: note = Synthetic
MGLCSNACARFCNDGEVIQSVEA

SEQ ID NO: 2611 - protein, 23 aa, synthetic construct
  REGION 1..23: note = Synthetic
MGLCSNACARFCNDGEVIQSVEA

SEQ ID NO: 2612 - protein, 37 aa, synthetic construct
  REGION 1..37: note = Synthetic
KLMELGHKIMRNLENTVKETIKYLKSLFSHAFEVVKT

SEQ ID NO: 2613 - protein, 28 aa, synthetic construct
  REGION 1..28: note = Synthetic
FISTVKNLATNVAGTVIDTIKCKVTGGC

SEQ ID NO: 2614 - protein, 42 aa, synthetic construct
  REGION 1..42: note = Synthetic
IADAVTCAKRVVRDPQGIRAWVAWRNHCHNRDVSQYVQGCGV

SEQ ID NO: 2615 - protein, 35 aa, synthetic construct
  REGION 1..35: note = Synthetic
EWEDFIQNMINFVNKIFELYPHLNTKVHLVGNSAA

SEQ ID NO: 2616 - protein, 17 aa, synthetic construct
  REGION 1..17: note = Synthetic
LESILQGFPRMKPSADA

SEQ ID NO: 2617 - protein, 36 aa, synthetic construct
  REGION 1..36: note = Synthetic
RGCRGFGDSCTPGKNECCPNHACSNKHKWCKVYLGK

SEQ ID NO: 2618 - protein, 36 aa, synthetic construct
  REGION 1..36: note = Synthetic
SKGGKCLRRCSQIVPTDIIGVCADGVPCCKSRQSTG

SEQ ID NO: 2619 - protein, 17 aa, synthetic construct
  REGION 1..17: note = Synthetic
VGKAAGKCMNGKCKCYT

SEQ ID NO: 2620 - protein, 28 aa, synthetic construct
  REGION 1..28: note = Synthetic
VTTFEDFIKNLKGFLFDIPFDCWKPVQK

SEQ ID NO: 2621 - protein, 34 aa, synthetic construct
  REGION 1..34: note = Synthetic
RLGRQVDGVWTDQQQMALESTLVSLLQERRNSQG

SEQ ID NO: 2622 - protein, 20 aa, synthetic construct
  REGION 1..20: note = Synthetic
CKGLGKSMESCQGDTCKCKA

SEQ ID NO: 2623 - protein, 18 aa, synthetic construct
  REGION 1..18: note = Synthetic
LQRLLELVYRVLRHLAEP

SEQ ID NO: 2624 - protein, 15 aa, synthetic construct
  REGION 1..15: note = Synthetic
DFLQQLTNFVRYLQK

SEQ ID NO: 2625 - protein, 22 aa, synthetic construct
  REGION 1..22: note = Synthetic
WFDPVKRCCSRYCYICIPCCPN

SEQ ID NO: 2626 - protein, 22 aa, synthetic construct
  REGION 1..22: note = Synthetic
WFDPVKRCCSRYCYICIPCCPN

SEQ ID NO: 2627 - protein, 14 aa, synthetic construct
  REGION 1..14: note = Synthetic
LKEFAGGVVTGVQS

SEQ ID NO: 2628 - protein, 14 aa, synthetic construct
  REGION 1..14: note = Synthetic
LKEFAGGVVTGVQS

SEQ ID NO: 2629 - protein, 41 aa, synthetic construct
  REGION 1..41: note = Synthetic
EFMQRALQDLRKTAYSLDARTETLLLQAERRALCACWPAGR

SEQ ID NO: 2630 - protein, 36 aa, synthetic construct
  REGION 1..36: note = Synthetic
RGCKGFGDSCTPGKNECCPNYACSSKHKWCKVLLGK

SEQ ID NO: 2631 - protein, 36 aa, synthetic construct
  REGION 1..36: note = Synthetic
RGCKGFGDSCTPGKNECCPNYACSSKHKWCKVNLGK

SEQ ID NO: 2632 - protein, 36 aa, synthetic construct
  REGION 1..36: note = Synthetic
RGCKGFGDSCTPGKNECCPNHACSNKHKWCKVYLGK

SEQ ID NO: 2633 - protein, 36 aa, synthetic construct; identical to SEQ ID NO: 2632
  REGION 1..36: note = Synthetic

SEQ ID NO: 2634 - protein, 36 aa, synthetic construct; identical to SEQ ID NO: 2632
  REGION 1..36: note = Synthetic

SEQ ID NO: 2635 - protein, 36 aa, synthetic construct; identical to SEQ ID NO: 2632
  REGION 1..36: note = Synthetic

SEQ ID NO: 2636 - protein, 36 aa, synthetic construct
  REGION 1..36: note = Synthetic
RGCKGFGDSCTPGKNECCPNPACSNKHKWCKVYLGK

SEQ ID NO: 2637 - protein, 36 aa, synthetic construct
  REGION 1..36: note = Synthetic
RGCKGFGDSCTPGKNECCPNHACSNKHKWCKAYLGK

SEQ ID NO: 2638 - protein, 25 aa, synthetic construct
  REGION 1..25: note = Synthetic
KLKNFAKGVAQSLLNKASCKLSGQC

SEQ ID NO: 2639 - protein, 19 aa, synthetic construct
  REGION 1..19: note = Synthetic
DKCIETLETIVKYLVQFTT

SEQ ID NO: 2640 - protein, 36 aa, synthetic construct
  REGION 1..36: note = Synthetic
RGCKGFGDSCTPGKNECCPNYACSSKHKWCKVYLGK

SEQ ID NO: 2641 - protein, 36 aa, synthetic construct; identical to SEQ ID NO: 2640
  REGION 1..36: note = Synthetic

SEQ ID NO: 2642 - protein, 36 aa, synthetic construct; identical to SEQ ID NO: 2640
  REGION 1..36: note = Synthetic

SEQ ID NO: 2643 - protein, 36 aa, synthetic construct; identical to SEQ ID NO: 2640
  REGION 1..36: note = Synthetic

SEQ ID NO: 2644 - protein, 36 aa, synthetic construct; identical to SEQ ID NO: 2640
  REGION 1..36: note = Synthetic

SEQ ID NO: 2645 - protein, 36 aa, synthetic construct; identical to SEQ ID NO: 2640
  REGION 1..36: note = Synthetic

SEQ ID NO: 2646 - protein, 36 aa, synthetic construct; identical to SEQ ID NO: 2640
  REGION 1..36: note = Synthetic

SEQ ID NO: 2647 - protein, 36 aa, synthetic construct; identical to SEQ ID NO: 2640
  REGION 1..36: note = Synthetic

SEQ ID NO: 2648 - protein, 36 aa, synthetic construct; identical to SEQ ID NO: 2640
  REGION 1..36: note = Synthetic

SEQ ID NO: 2649 - protein, 36 aa, synthetic construct; identical to SEQ ID NO: 2640
  REGION 1..36: note = Synthetic

SEQ ID NO: 2650 - protein, 36 aa, synthetic construct; identical to SEQ ID NO: 2640
  REGION 1..36: note = Synthetic

SEQ ID NO: 2651 - protein, 36 aa, synthetic construct; identical to SEQ ID NO: 2640
  REGION 1..36: note = Synthetic

SEQ ID NO: 2652 - protein, 36 aa, synthetic construct
  REGION 1..36: note = Synthetic
RGCKGFGDSCTPGKNECCPNYACSGKHKWCKVYLGK

SEQ ID NO: 2653 - protein, 36 aa, synthetic construct
  REGION 1..36: note = Synthetic
RGCKGFGDSCTPGKNECCPNYACSSKHKWCKVYSGK

SEQ ID NO: 2654 - protein, 31 aa, synthetic construct
  REGION 1..31: note = Synthetic
GGIRAAHAILGGLHLTLDWAVRGLLLLKTRL

SEQ ID NO: 2655 - protein, 36 aa, synthetic construct
  REGION 1..36: note = Synthetic
RGCKGFGDSCAPGKNECCPNHACSNKHKWCKVYLGK

SEQ ID NO: 2656 - protein, 18 aa, synthetic construct
  REGION 1..18: note = Synthetic
IKKAGTELVNFLNYFLEL

SEQ ID NO: 2657 - protein, 27 aa, synthetic construct
  REGION 1..27: note = Synthetic
LLDVVKGAAKNLLASALDKLKCKVTGC

SEQ ID NO: 2658 - protein, 42 aa, synthetic construct
  REGION 1..42: note = Synthetic
KAVEQVKNAFNKLQEKGIYKAMSEFDIFINYIEAYMTMKIRN

SEQ ID NO: 2659 - protein, 42 aa, synthetic construct; identical to SEQ ID NO: 2658
  REGION 1..42: note = Synthetic

SEQ ID NO: 2660 - protein, 33 aa, synthetic construct
  REGION 1..33: note = Synthetic
KTIQSWLNKFLSCLHIGKLSLSFLLLAIFSIVF

SEQ ID NO: 2661 - protein, 14 aa, synthetic construct
  REGION 1..14: note = Synthetic
FTKIKDALKKISQH

SEQ ID NO: 2662 - protein, 29 aa, synthetic construct
  REGION 1..29: note = Synthetic
KVLSEAVEQCTKACSSVCTGGSTAAVKSA

SEQ ID NO: 2663 - protein, 26 aa, synthetic construct
  REGION 1..26: note = Synthetic
DDAVDRCGEACYRFCTKHVDAATNVS

SEQ ID NO: 2664 - protein, 23 aa, synthetic construct
  REGION 1..23: note = Synthetic
MGLCSNACARFCNDGDVIQSVEA

SEQ ID NO: 2665 - protein, 24 aa, synthetic construct
  REGION 1..24: note = Synthetic
KVAKTVAKQAAKQGAKYIANKQME

SEQ ID NO: 2666 - protein, 24 aa, synthetic construct
  REGION 1..24: note = Synthetic
KVAKTVAKQAAKQGAKYIANKQTE

SEQ ID NO: 2667 - protein, 14 aa, synthetic construct
  REGION 1..14: note = Synthetic
DLLKDVIEGVEKLL

SEQ ID NO: 2668 - protein, 15 aa, synthetic construct
  REGION 1..15: note = Synthetic
DFLHGLTNFVRYLQK

SEQ ID NO: 2669 - protein, 12 aa, synthetic construct
  REGION 1..12: note = Synthetic
GAQSGMGCGRRF

SEQ ID NO: 2670 - protein, 42 aa, synthetic construct
  REGION 1..42: note = Synthetic
ITEAVACAKRVVRDPQGIRAWVAWKAHCQNRDVSQYVQGCGV

SEQ ID NO: 2671 - protein, 42 aa, synthetic construct
  REGION 1..42: note = Synthetic
ITEAVACAKRVVRDPQGIRAWVAWKAHCQNRDVSQYIQGCGV

SEQ ID NO: 2672 - protein, 23 aa, synthetic construct
  REGION 1..23: note = Synthetic
FESCMKKCSKICNKKKESDDIYV

SEQ ID NO: 2673 - protein, 41 aa, synthetic construct
  REGION 1..41: note = Synthetic
GMIEACIGNGGRCNENVGPPYCCSGFCLRQPNQGYGVCRNR

SEQ ID NO: 2674 - protein, 42 aa, synthetic construct
  REGION 1..42: note = Synthetic
CLKTLAGSVKGINYGAASALPGKCGIRIPYPISPSTDCSRVN

SEQ ID NO: 2675 - protein, 38 aa, synthetic construct
  REGION 1..38: note = Synthetic
KIVDHCPSGCASTLDLSREAFAQIANPVAGIINIDYFP

SEQ ID NO: 2676 - protein, 37 aa, synthetic construct
  REGION 1..37: note = Synthetic
NCAKKIVSDVHGMNAWVAWRNRCKGTDVNAWIRGCRL

SEQ ID NO: 2677 - protein, 40 aa, synthetic construct
  REGION 1..40: note = Synthetic
DFARSVVRKFIDLNQHSFGLVRERDAEQSRFRAICGPQVH

SEQ ID NO: 2678 - protein, 26 aa, synthetic construct
  REGION 1..26: note = Synthetic
IYEMLKDIFHVFERGYTSPGWNETIV

SEQ ID NO: 2679 - protein, 20 aa, synthetic construct
  REGION 1..20: note = Synthetic
RTLQKLWNHARDWCDPCPWG

SEQ ID NO: 2680 - protein, 14 aa, synthetic construct
  REGION 1..14: note = Synthetic
EAVKKLLEALSHLV

SEQ ID NO: 2681 - protein, 14 aa, synthetic construct
  REGION 1..14: note = Synthetic
EAVKKLLEALSHLV

SEQ ID NO: 2682 - protein, 42 aa, synthetic construct
  REGION 1..42: note = Synthetic
ITQAVACAKRVVRDPQGIRAWVAWKAHCQNRDVSQYVQGCGV

SEQ ID NO: 2683 - protein, 30 aa, synthetic construct
  REGION 1..30: note = Synthetic
GQCTDCCKKAGHTGGTCIYFKCKCGAESGR

SEQ ID NO: 2684 - protein, 36 aa, synthetic construct
  REGION 1..36: note = Synthetic
RGCKGFGDSCTPGKNECCPNYACSCKHKWCKVYLGK

SEQ ID NO: 2685 - protein, 14 aa, synthetic construct
  REGION 1..14: note = Synthetic
EAVKKLLEALSHLV

SEQ ID NO: 2686 - protein, 16 aa, synthetic construct
  REGION 1..16: note = Synthetic
LPSLVSGAVSLVKILG

SEQ ID NO: 2687 - protein, 40 aa, synthetic construct
  REGION 1..40: note = Synthetic
KWVKTAIKTVDGRASASKSKAETIPTQAQRSASTAVTLTG

SEQ ID NO: 2688 - protein, 38 aa, synthetic construct
  REGION 1..38: note = Synthetic
SRIAGGVERMQRGCSLTCPDIKYNGKYIYCCTRDNCNA

SEQ ID NO: 2689 - protein, 28 aa, synthetic construct
  REGION 1..28: note = Synthetic
GDSCSRWYNHCCSKLCTSRNSGPTCSRP

SEQ ID NO: 2690 - protein, 36 aa, synthetic construct; identical to SEQ ID NO: 2618
  REGION 1..36: note = Synthetic

SEQ ID NO: 2691 - protein, 22 aa, synthetic construct
  REGION 1..22: note = Synthetic
DNVASAWNQAFDNIFQTVFSHL

SEQ ID NO: 2692 - protein, 14 aa, synthetic construct
  REGION 1..14: note = Synthetic
LSDVLDRWLDGCDL

SEQ ID NO: 2693 - protein, 24 aa, synthetic construct
  REGION 1..24: note = Synthetic
KVAKTVAKQAAKQGAKYIANKQTE

SEQ ID NO: 2694 - protein, 33 aa, synthetic construct
  REGION 1..33: note = Synthetic
CFDCARACMRRGKYIRTCSFERKLCRYSISDIK

SEQ ID NO: 2695 - protein, 16 aa, synthetic construct
  REGION 1..16: note = Synthetic
LFDLLKTIIEGVEKLL

SEQ ID NO: 2696 - protein, 16 aa, synthetic construct
  REGION 1..16: note = Synthetic
LFDLLKTIIEGVEKLL

SEQ ID NO: 2697 - protein, 19 aa, synthetic construct
  REGION 1..19: note = Synthetic
IEQLMEKIANLWYTRVLGY

SEQ ID NO: 2698 - protein, 25 aa, synthetic construct
  REGION 1..25: note = Synthetic
VKKAGTDLLNFLSNFMDLKTQPATQ

SEQ ID NO: 2699 - protein, 25 aa, synthetic construct
  REGION 1..25: note = Synthetic
VKKAGTDLINFLSNFMDLRTQPATQ

SEQ ID NO: 2700 - protein, 25 aa, synthetic construct
  REGION 1..25: note = Synthetic
VKKAGTDLINFLSNFMDLRTQPATQ

SEQ ID NO: 2701 - protein, 38 aa, synthetic construct
  REGION 1..38: note = Synthetic
RKAVSELSNVLNFLSPKSNLKKRKRSQTLFRGRRASKY

SEQ ID NO: 2702 - protein, 20 aa, synthetic construct
  REGION 1..20: note = Synthetic
QAIEGALRIAKKLIGDRWGR

SEQ ID NO: 2703 - protein, 42 aa, synthetic construct
  REGION 1..42: note = Synthetic
KAVEQVKSAFSKLQEEGVYKAMSEFDIFINYIETYMTMKIKS

SEQ ID NO: 2704 - protein, 22 aa, synthetic construct
  REGION 1..22: note = Synthetic
KQFLDYLQEFLGVINTEWTIEG

SEQ ID NO: 2705 - protein, 18 aa, synthetic construct
  REGION 1..18: note = Synthetic
TIVQKFPNLLQQIVYEEC

SEQ ID NO: 2706 - protein, 13 aa, synthetic construct
  REGION 1..13: note = Synthetic
WTTFCQSIYSTLT

SEQ ID NO: 2707 - protein, 12 aa, synthetic construct
  REGION 1..12: note = Synthetic
FYGSYVGLGSSL

SEQ ID NO: 2708 - protein, 12 aa, synthetic construct
  REGION 1..12: note = Synthetic
FYGSYVGLGSSL

SEQ ID NO: 2709 - protein, 12 aa, synthetic construct
  REGION 1..12: note = Synthetic
FYGSYVGLGSSL

SEQ ID NO: 2710 - protein, 12 aa, synthetic construct
  REGION 1..12: note = Synthetic
FYGSYVGLGSSL

SEQ ID NO: 2711 - protein, 12 aa, synthetic construct
  REGION 1..12: note = Synthetic
FYGSYVGLGSSL

SEQ ID NO: 2712 - protein, 12 aa, synthetic construct
  REGION 1..12: note = Synthetic
FYGSYVGLGSSL

SEQ ID NO: 2713 - protein, 12 aa, synthetic construct
  REGION 1..12: note = Synthetic
FYGSYVGLGSSL

SEQ ID NO: 2714 - protein, 12 aa, synthetic construct
  REGION 1..12: note = Synthetic
FYGSYVGLGSSL

SEQ ID NO: 2715 - protein, 28 aa, synthetic construct
  REGION 1..28: note = Synthetic
YEIFDKVKSFFNKIMVKRRKQDDKNVLT

SEQ ID NO: 2716 - protein, 14 aa, synthetic construct
  REGION 1..14: note = Synthetic
IGHLIKTALGMLGL

SEQ ID NO: 2717 - protein, 41 aa, synthetic construct
  REGION 1..41: note = Synthetic
LKQILHSWGEECRACAEKHDYVNLIKELAPKYVETRPQTEL

SEQ ID NO: 2718 - protein, 36 aa, synthetic construct
  REGION 1..36: note = Synthetic
SKGGKCLNRCPQIVPTNVIGVCATGVPCCKSRQSTG

SEQ ID NO: 2719 - protein, 28 aa, synthetic construct
  REGION 1..28: note = Synthetic
EVMKEAVERCNNACSEVCTKGSYAVVTA

SEQ ID NO: 2720 - protein, 29 aa, synthetic construct
  REGION 1..29: note = Synthetic
GICNEGKKCCRRWWILEPYPTPVPKGKSP

SEQ ID NO: 2721 - protein, 29 aa, synthetic construct
  REGION 1..29: note = Synthetic
GICNEGKKCCRRWWILEPYPTPVPKGKSP

SEQ ID NO: 2722 - protein, 41 aa, synthetic construct
  REGION 1..41: note = Synthetic
MDNFKKYLSTAPVLLTVWLSITASGIMIINRLYPDPLIFPI

SEQ ID NO: 2723 - protein, 41 aa, synthetic construct; identical to SEQ ID NO: 2722
  REGION 1..41: note = Synthetic

SEQ ID NO: 2724 - protein, 29 aa, synthetic construct
  REGION 1..29: note = Synthetic
EEANHAVDRCNEACRRFCTKEAETVTVVS

SEQ ID NO: 2725 - protein, 29 aa, synthetic construct
  REGION 1..29: note = Synthetic
EEANHAVDRCNEACRRFCTKEAETVTVVS

SEQ ID NO: 2726 - protein, 29 aa, synthetic construct
  REGION 1..29: note = Synthetic
EEANHAVDRCNEACRRFCSKEAETVTVLS

SEQ ID NO: 2727 - protein, 15 aa, synthetic construct
  REGION 1..15: note = Synthetic
IEKLVNTALGLLSGL

SEQ ID NO: 2728 - protein, 11 aa, synthetic construct
  REGION 1..11: note = Synthetic
IEEVEDWIASY

SEQ ID NO: 2729 - protein, 34 aa, synthetic construct
  REGION 1..34: note = Synthetic
RVIKCIDHICQYARNLPDFASEISESTKMPCKGE

SEQ ID NO: 2730 - protein, 11 aa, synthetic construct
  REGION 1..11: note = Synthetic
INAVSALVHHF

SEQ ID NO: 2731 - protein, 42 aa, synthetic construct
  REGION 1..42: note = Synthetic
KAVEQVKNAFSKLQEKGVYKAMSEFDIFINYIEAYMTMKIRN

SEQ ID NO: 2732 - protein, 33 aa, synthetic construct
  REGION 1..33: note = Synthetic
CFDCARACMRRGKYIRTCSFERKLCRCSISGIK

SEQ ID NO: 2733 - protein, 25 aa, synthetic construct
  REGION 1..25: note = Synthetic
AIEKCISACSTLCTKGFVKPATETA

SEQ ID NO: 2734 - protein, 20 aa, synthetic construct
  REGION 1..20: note = Synthetic
VPKALYSAASCARSICDDNP

SEQ ID NO: 2735 - protein, 40 aa, synthetic construct
  REGION 1..40: note = Synthetic
LGRVGTRYISSLFNKKREEGQSNHANSPTTLPSRIQKMTK

SEQ ID NO: 2736 - protein, 40 aa, synthetic construct
  REGION 1..40: note = Synthetic
LGRVGTRYISSLFNKKREEGQSNHANSPTTSPSRIQKMTK

SEQ ID NO: 2737 - protein, 40 aa, synthetic construct
  REGION 1..40: note = Synthetic
ILRKARNLLNHGILLSSNNRSFCFIIQISKINPFERFLEM

SEQ ID NO: 2738 - protein, 21 aa, synthetic construct
  REGION 1..21: note = Synthetic
KAFSLAQSIFTGNSKSFFCNK

SEQ ID NO: 2739 - protein, 27 aa, synthetic construct
  REGION 1..27: note = Synthetic
GSCASVCRRVIGVAAGKCINGRCVCYP

SEQ ID NO: 2740 - protein, 27 aa, synthetic construct
  REGION 1..27: note = Synthetic
GSCASVCRRVIGVAAGKCINGRCVCYP

SEQ ID NO: 2741 - protein, 27 aa, synthetic construct
  REGION 1..27: note = Synthetic
GSCASVCRRVIGVAAGKCINGRCVCYP

SEQ ID NO: 2742 - protein, 12 aa, synthetic construct
  REGION 1..12: note = Synthetic
AFLNGLTDYLQN

SEQ ID NO: 2743 - protein, 27 aa, synthetic construct
  REGION 1..27: note = Synthetic
KECWSVCKDLFGVDRGKCMGKKCRCYQ

SEQ ID NO: 2744 - protein, 34 aa, synthetic construct
  REGION 1..34: note = Synthetic
IRKFLETIDDMLDDLARIVSDVGQNAAQRWVVYC

SEQ ID NO: 2745 - protein, 24 aa, synthetic construct
  REGION 1..24: note = Synthetic
KVAKTVAKQAAKQGAKYVVNKQME

SEQ ID NO: 2746 - protein, 24 aa, synthetic construct
  REGION 1..24: note = Synthetic
KVAKTVAKQAAKQGAKYVANKHME

SEQ ID NO: 2747 - protein, 29 aa, synthetic construct
  REGION 1..29: note = Synthetic
GYYGQCDECCKKAGDRAGICEYYKCKCNP

SEQ ID NO: 2748 - protein, 32 aa, synthetic construct
  REGION 1..32: note = Synthetic
VLYQVLSLFKRFLEQQHLQLKNESYEQPTHTE

SEQ ID NO: 2749 - protein, 27 aa, synthetic construct
  REGION 1..27: note = Synthetic
SFYSSMGDLCNNTKSVCCMVPVRMDNI

SEQ ID NO: 2750 - protein, 24 aa, synthetic construct
  REGION 1..24: note = Synthetic
RGCRRCCSYAGEAVEAETKAKPQN

SEQ ID NO: 2751 - protein, 17 aa, synthetic construct
  REGION 1..17: note = Synthetic
FLNTWITFCQSIISKLT

SEQ ID NO: 2752 - protein, 27 aa, synthetic construct
  REGION 1..27: note = Synthetic
NFVHTFIDGVDNVVCKTKDVIFTNISQ

SEQ ID NO: 2753 - protein, 25 aa, synthetic construct
  REGION 1..25: note = Synthetic
GLFSVLGSVAKHLLPHVAPIIAEKL

SEQ ID NO: 2754 - protein, 37 aa, synthetic construct
  REGION 1..37: note = Synthetic
VRECKGFGKSCVPGKNECCSGYACNSRDKWCKVLLGK

SEQ ID NO: 2755 - protein, 28 aa, synthetic construct
  REGION 1..28: note = Synthetic
AQLRELAEKMTDKDPKRLSPSGPDPHHH

SEQ ID NO: 2756 - protein, 33 aa, synthetic construct
  REGION 1..33: note = Synthetic
ARKMVTRALRALQNPSSSPLLSSPQSFSSLTLA

SEQ ID NO: 2757 - protein, 22 aa, synthetic construct
  REGION 1..22: note = Synthetic
NGFLNIIGQAANAVQNAASLCV

SEQ ID NO: 2758 - protein, 22 aa, synthetic construct
  REGION 1..22: note = Synthetic
NGFLNIIGQAANAVQNAASLCV

SEQ ID NO: 2759 - protein, 35 aa, synthetic construct
  REGION 1..35: note = Synthetic
INQMERCASHMTDLVDSVHFPLTDEHKTEAGQQEQ

SEQ ID NO: 2760 - protein, 25 aa, synthetic construct
  REGION 1..25: note = Synthetic
NVLTFLKSLLEVFQKEKMRGMGGKI

SEQ ID NO: 2761 - protein, 27 aa, synthetic construct
  REGION 1..27: note = Synthetic
GSCASVCRKVIGVAAGKCINGRCVCYP

SEQ ID NO: 2762 - protein, 16 aa, synthetic construct
  REGION 1..16: note = Synthetic
DKLASDLTKLLQHLPD

SEQ ID NO: 2763 - protein, 24 aa, synthetic construct
  REGION 1..24: note = Synthetic
NVADSLAKSALNVLRFSVFVTATE

SEQ ID NO: 2764 - protein, 18 aa, synthetic construct
  REGION 1..18: note = Synthetic
VWDMFYELFEGIRKLIFK

SEQ ID NO: 2765 - protein, 42 aa, synthetic construct
  REGION 1..42: note = Synthetic
FGRAGAKFIRFGRSRNTWEDGYASPSVNELYVKRGAKFIRFG

SEQ ID NO: 2766 - protein, 17 aa, synthetic construct
  REGION 1..17: note = Synthetic
FLNKWITFCQSIYSTMT

SEQ ID NO: 2767 - protein, 30 aa, synthetic construct
  REGION 1..30: note = Synthetic
GLAGAISSALDKLKQSQLIKNYAKKLGYPR

SEQ ID NO: 2768 - protein, 22 aa, synthetic construct
  REGION 1..22: note = Synthetic
IVHSWYYFLYSFLRLYNLYVLY

SEQ ID NO: 2769 - protein, 11 aa, synthetic construct
  REGION 1..11: note = Synthetic
ISAISAIANHL

SEQ ID NO: 2770 - protein, 29 aa, synthetic construct
  REGION 1..29: note = Synthetic
EEANDAVDRCNEACRRFCTKEAETVTVVS

SEQ ID NO: 2771 - protein, 14 aa, synthetic construct
  REGION 1..14: note = Synthetic
KWVQKYISDLKLNA

SEQ ID NO: 2772 - protein, 21 aa, synthetic construct
  REGION 1..21: note = Synthetic
GLLGSIFGAGKKIACALSGLC

SEQ ID NO: 2773 - protein, 22 aa, synthetic construct
  REGION 1..22: note = Synthetic
DNVASAWNQALDNVYATIFSKL

SEQ ID NO: 2774 - protein, 16 aa, synthetic construct
  REGION 1..16: note = Synthetic
KVAKKLISHVAKKQLQ

SEQ ID NO: 2775 - protein, 40 aa, synthetic construct
  REGION 1..40: note = Synthetic
RKLYTIMNSFCRRDLVFLLDDCNALEYPIPVTTVLPDRQR

SEQ ID NO: 2776 - protein, 24 aa, synthetic construct
  REGION 1..24: note = Synthetic
VKRVPTIAATLVFFFSNSFLPASR

SEQ ID NO: 2777 - protein, 11 aa, synthetic construct
  REGION 1..11: note = Synthetic
LRKMGGDLNSL

SEQ ID NO: 2778 - protein, 24 aa, synthetic construct
  REGION 1..24: note = Synthetic
KVAKTVAKQAAKQGAKYVVNKQME

SEQ ID NO: 2779 - protein, 24 aa, synthetic construct
  REGION 1..24: note = Synthetic
KVAKTVAKQAAKQGAKYVANKHME

SEQ ID NO: 2780 - protein, 20 aa, synthetic construct
  REGION 1..20: note = Synthetic
ITEFLNKWITFCQSIISTLT

SEQ ID NO: 2781 - protein, 12 aa, synthetic construct
  REGION 1..12: note = Synthetic
FDAFFGAVFAKM

SEQ ID NO: 2782 - protein, 11 aa, synthetic construct
  REGION 1..11: note = Synthetic
INAISAIAHHL

SEQ ID NO: 2783 - protein, 20 aa, synthetic construct
  REGION 1..20: note = Synthetic
ITEFLNKWITFCQSIFSTLT

SEQ ID NO: 2784 - protein, 20 aa, synthetic construct
  REGION 1..20: note = Synthetic
ITEFLNKWITFCQSIFSTLT

SEQ ID NO: 2785 - protein, 20 aa, synthetic construct
  REGION 1..20: note = Synthetic
ITEFLNKWITFCQSIFSTLT

SEQ ID NO: 2786 - protein, 20 aa, synthetic construct
  REGION 1..20: note = Synthetic
ITEFLNKWITFCQSIFSTLT

SEQ ID NO: 2787 - protein, 20 aa, synthetic construct
  REGION 1..20: note = Synthetic
ITEFLNKWITFCQSIFSTLT

SEQ ID NO: 2788 - protein, 30 aa, synthetic construct
  REGION 1..30: note = Synthetic
CSRAGENCYKSGRCCDGLYCKAYVVTCYKP

SEQ ID NO: 2789 - protein, 17 aa, synthetic construct
  REGION 1..17: note = Synthetic
KIFDALDKCLQDAAKVA

SEQ ID NO: 2790 - protein, 25 aa, synthetic construct
  REGION 1..25: note = Synthetic
QECQDCCKKAGHSGGTCMFFKCKCA

SEQ ID NO: 2791 - protein, 18 aa, synthetic construct
  REGION 1..18: note = Synthetic
AKKAVGKCDDFKCKCIKL

SEQ ID NO: 2792 - protein, 20 aa, synthetic construct
  REGION 1..20: note = Synthetic
ITEFLNKWITFCQSIFSTLT

SEQ ID NO: 2793 - protein, 20 aa, synthetic construct
  REGION 1..20: note = Synthetic
ITEFLNKWITFCQSIFSTLT

SEQ ID NO: 2794 - protein, 12 aa, synthetic construct
  REGION 1..12: note = Synthetic
NWCDHLCSCCGS

SEQ ID NO: 2795 - protein, 15 aa, synthetic construct
  REGION 1..15: note = Synthetic
RFLGGILNTITGLLG

SEQ ID NO: 2796 - protein, 28 aa, synthetic construct
  REGION 1..28: note = Synthetic
KHAHSMITSMLSFVNSVVNFGRSFVRNE

SEQ ID NO: 2797 - protein, 20 aa, synthetic construct
  REGION 1..20: note = Synthetic
DIMYQAERALEKLASSFRCE

SEQ ID NO: 2798 - protein, 35 aa, synthetic construct
  REGION 1..35: note = Synthetic
NVAAKAFHRIGRTIRDECCSNPACRVNNPHVCRRR

SEQ ID NO: 2799 - protein, 14 aa, synthetic construct
  REGION 1..14: note = Synthetic
WGECYERIASGISG

SEQ ID NO: 2800 - protein, 17 aa, synthetic construct
  REGION 1..17: note = Synthetic
FTEFIQSFEKVIQKECK

SEQ ID NO: 2801 - protein, 39 aa, synthetic construct
  REGION 1..39: note = Synthetic
IAEAWKGAKECNAKCAALGTTRGGVCQKFLGDLYCCCWD

SEQ ID NO: 2802 - protein, 33 aa, synthetic construct
  REGION 1..33: note = Synthetic
DEIMQGFIRAFRPLPRHLWYLLDLKQMEEPCRF

SEQ ID NO: 2803 - protein, 21 aa, synthetic construct
  REGION 1..21: note = Synthetic
FRSAEDCMRTCGGAIGPRENL

SEQ ID NO: 2804 - protein, 30 aa, synthetic construct
  REGION 1..30: note = Synthetic
VLDNVETALHNAAKAGFKLIKPIEKLIMPK

SEQ ID NO: 2805 - protein, 36 aa, synthetic construct
  REGION 1..36: note = Synthetic
RGCKGFGDSCTPGKNECCPDHACSNKHKWCKVYLGK

SEQ ID NO: 2806 - protein, 22 aa, synthetic construct
  REGION 1..22: note = Synthetic
TQARSCCTRLGRCCHVAKGYSG

SEQ ID NO: 2807 - protein, 22 aa, synthetic construct
  REGION 1..22: note = Synthetic
TQARSCCTRLGRCCHVAKGYSG

SEQ ID NO: 2808 - protein, 22 aa, synthetic construct
  REGION 1..22: note = Synthetic
TQARSCCTRLGRCCHVAKGYSG

SEQ ID NO: 2809 - protein, 22 aa, synthetic construct
  REGION 1..22: note = Synthetic
TQARSCCTRLGRCCHVAKGYSG

SEQ ID NO: 2810 - protein, 42 aa, synthetic construct
  REGION 1..42: note = Synthetic
IFKHGRHAAKHIGHAAVNHYLGEQQDLDKRAVDEDPNVIVFE

SEQ ID NO: 2811 - protein, 42 aa, synthetic construct
  REGION 1..42: note = Synthetic
TEMCRAMDGYLRCSHPIILAKCGSDAWTLVSTVCLSRAKLFF

SEQ ID NO: 2812 - protein, 20 aa, synthetic construct
  REGION 1..20: note = Synthetic
DCCSNVCSTMSYVCQENWSG

SEQ ID NO: 2813 - protein, 19 aa, synthetic construct
  REGION 1..19: note = Synthetic
QEMGQVADYVLEQAKAGWK

SEQ ID NO: 2814 - protein, 19 aa, synthetic construct
  REGION 1..19: note = Synthetic
QEMGQVADYVLEQAKAGWK

SEQ ID NO: 2815 - protein, 17 aa, synthetic construct
  REGION 1..17: note = Synthetic
VGKAAGKCMNGKCKCYP

SEQ ID NO: 2816 - protein, 20 aa, synthetic construct
  REGION 1..20: note = Synthetic
LAKYYSALRHYINLITRQRY

SEQ ID NO: 2817 - protein, 20 aa, synthetic construct
  REGION 1..20: note = Synthetic
LAKYYSALRHYINLITRQRY

SEQ ID NO: 2818 - protein, 20 aa, synthetic construct
  REGION 1..20: note = Synthetic
LAKYYSALRHYINLITRQRY

SEQ ID NO: 2819 - protein, 20 aa, synthetic construct
  REGION 1..20: note = Synthetic
LAKYYSALRHYINLITRQRY

SEQ ID NO: 2820 - protein, 20 aa, synthetic construct
  REGION 1..20: note = Synthetic
LAKYYSALRHYINLITRQRY

SEQ ID NO: 2821 - protein, 26 aa, synthetic construct
  REGION 1..26: note = Synthetic
KYANSCCQNIEDCLYLNVWIPAPKPK

SEQ ID NO: 2822 - protein, 25 aa, synthetic construct
  REGION 1..25: note = Synthetic
QECQDCCKKAGHNGGTCMFFKCKCA

SEQ ID NO: 2823 - protein, 25 aa, synthetic construct
  REGION 1..25: note = Synthetic
QECQDCCKKAGHNGGTCMFFKCKCA

SEQ ID NO: 2824 - protein, 25 aa, synthetic construct
  REGION 1..25: note = Synthetic
QECQDCCKKAGHNGGTCMFFKCKCA

SEQ ID NO: 2825 - protein, 25 aa, synthetic construct
  REGION 1..25: note = Synthetic
QECQDCCKKAGHNGGTCMFFKCKCA

SEQ ID NO: 2826 - protein, 35 aa, synthetic construct
  REGION 1..35: note = Synthetic
GLFRFARGYVQASTHEFNLKTGNAIVEYNCYLLHY

SEQ ID NO: 2827 - protein, 31 aa, synthetic construct; identical to SEQ ID NO: 2654
  REGION 1..31: note = Synthetic

SEQ ID NO: 2828 - protein, 12 aa, synthetic construct
  REGION 1..12: note = Synthetic
CKWVEKAWKGLL

SEQ ID NO: 2829 - protein, 21 aa, synthetic construct
  REGION 1..21: note = Synthetic
TIVEFLNRWITFCQSIISTMT

SEQ ID NO: 2830 - protein, 28 aa, synthetic construct
  REGION 1..28: note = Synthetic
DCYRRFEKGVEKGQICWCIETGVTFSKE

SEQ ID NO: 2831 - protein, 33 aa, synthetic construct; identical to SEQ ID NO: 2732
  REGION 1..33: note = Synthetic

SEQ ID NO: 2832 - protein, 33 aa, synthetic construct
  REGION 1..33: note = Synthetic
CFDCARACMRRGKYIRTCSFERKLCRCSISDIK

SEQ ID NO: 2833 - protein, 18 aa, synthetic construct
  REGION 1..18: note = Synthetic
NGISYIAKSAGSILNFSK

SEQ ID NO: 2834 - protein, 17 aa, synthetic construct
  REGION 1..17: note = Synthetic
LKKCCEGFCGKACMDPK

SEQ ID NO: 2835 - protein, 20 aa, synthetic construct
  REGION 1..20: note = Synthetic
MKKIVEHMAERVEDMKIRKK

SEQ ID NO: 2836 - protein, 33 aa, synthetic construct; identical to SEQ ID NO: 2832
  REGION 1..33: note = Synthetic

SEQ ID NO: 2837 - protein, 15 aa, synthetic construct
  REGION 1..15: note = Synthetic
DFLHELTNFVRYLQK

SEQ ID NO: 2838 - protein, 15 aa, synthetic construct
  REGION 1..15: note = Synthetic
DFLHELTNFVRYLQK

SEQ ID NO: 2839 - protein, 42 aa, synthetic construct
  REGION 1..42: note = Synthetic
FFKKAAHVGKHVGKAALTHYLGDKQELNKRAVDEDPNVIVFE

SEQ ID NO: 2840 - protein, 42 aa, synthetic construct; identical to SEQ ID NO: 2839
  REGION 1..42: note = Synthetic

SEQ ID NO: 2841 - protein, 19 aa, synthetic construct
  REGION 1..19: note = Synthetic
RACQQFLKQCQLRSFALPL

SEQ ID NO: 2842 - protein, 13 aa, synthetic construct
  REGION 1..13: note = Synthetic
GPGLVGGILGGIL

SEQ ID NO: 2843 - protein, 23 aa, synthetic construct
  REGION 1..23: note = Synthetic
AYDDFVKQAQEVQKKLHEAASKQ

SEQ ID NO: 2844 - protein, 30 aa, synthetic construct
  REGION 1..30: note = Synthetic
GAIKDALKGAAKTVAVELLKKAQCKLEKTC

SEQ ID NO: 2845 - protein, 22 aa, synthetic construct
  REGION 1..22: note = Synthetic
NNLKEMLDYLYQMMNMKENTSS

SEQ ID NO: 2846 - protein, 17 aa, synthetic construct
  REGION 1..17: note = Synthetic
GGNCDGIMRQCKCIRQC

SEQ ID NO: 2847 - protein, 11 aa, synthetic construct
  REGION 1..11: note = Synthetic
INAISAIADHF

SEQ ID NO: 2848 - protein, 22 aa, synthetic construct
  REGION 1..22: note = Synthetic
TQARSCCTRLGRCCHVAKGYSG

SEQ ID NO: 2849 - protein, 17 aa, synthetic construct
  REGION 1..17: note = Synthetic
FLNGWITFCQSIISTLT

SEQ ID NO: 2850 - protein, 17 aa, synthetic construct
  REGION 1..17: note = Synthetic
FLNGWITFCQSIISTLT

SEQ ID NO: 2851 - protein, 17 aa, synthetic construct
  REGION 1..17: note = Synthetic
FLNGWITFCQSIISTLT

SEQ ID NO: 2852 - protein, 17 aa, synthetic construct
  REGION 1..17: note = Synthetic
FLNGWITFCQSIISTLT

SEQ ID NO: 2853 - protein, 17 aa, synthetic construct
  REGION 1..17: note = Synthetic
FLNGWITFCQSIISTLT

SEQ ID NO: 2854 - protein, 17 aa, synthetic construct
  REGION 1..17: note = Synthetic
FLNGWITFCQSIISTLT

SEQ ID NO: 2855 - protein, 26 aa, synthetic construct
  REGION 1..26: note = Synthetic
SNFKDLVDSLLQVLNVKERTPQLNQQ

SEQ ID NO: 2856 - protein, 29 aa, synthetic construct
  REGION 1..29: note = Synthetic
EIVNEAVDKCAKACSTVCTKSSMNAVETA

SEQ ID NO: 2857 - protein, 21 aa, synthetic construct
  REGION 1..21: note = Synthetic
SMVSLLKRLLTVTRWKLQITG

SEQ ID NO: 2858 - protein, 16 aa, synthetic construct
  REGION 1..16: note = Synthetic
NVWNCIGGGCSKTCGY

SEQ ID NO: 2859 - protein, 17 aa, synthetic construct
  REGION 1..17: note = Synthetic
NLFASALDTLKCKITGC

SEQ ID NO: 2860 - protein, 25 aa, synthetic construct
  REGION 1..25: note = Synthetic
WLAGCPSGWHNCKKHGPTIGWCCKQ

SEQ ID NO: 2861 - protein, 25 aa, synthetic construct
  REGION 1..25: note = Synthetic
WLAGCPSGWHNCKKHGPTIGWCCKQ

SEQ ID NO: 2862 - protein, 25 aa, synthetic construct
  REGION 1..25: note = Synthetic
WLAGCPSGWHNCKKHGPTIGWCCKQ

SEQ ID NO: 2863 - protein, 25 aa, synthetic construct
  REGION 1..25: note = Synthetic
WLAGCPSGWHNCKKHGPTIGWCCKQ

SEQ ID NO: 2864 - protein, 25 aa, synthetic construct
  REGION 1..25: note = Synthetic
WLAGCPSGWHNCKKHGPTIGWCCKQ

SEQ ID NO: 2865 - protein, 25 aa, synthetic construct
  REGION 1..25: note = Synthetic
WLAGCPSGWHNCKKHGPTIGWCCKQ

SEQ ID NO: 2866 - protein, 25 aa, synthetic construct
  REGION 1..25: note = Synthetic
WLAGCPSGWHNCKKHGPTIGWCCKQ

SEQ ID NO: 2867 - protein, 25 aa, synthetic construct
  REGION 1..25: note = Synthetic
WLAGCPSGWHNCKKHGPTIGWCCKQ

SEQ ID NO: 2868 - protein, 13 aa, synthetic construct
  REGION 1..13: note = Synthetic
KRLRKMGGDLNSP

SEQ ID NO: 2869 - protein, 28 aa, synthetic construct
  REGION 1..28: note = Synthetic
DCYRRFEQGVAKGIQCWCIEEDVTYKGV

SEQ ID NO: 2870 - protein, 18 aa, synthetic construct
  REGION 1..18: note = Synthetic
GLVSECCGTCNVLRNRCV

SEQ ID NO: 2871 - protein, 20 aa, synthetic construct
  REGION 1..20: note = Synthetic
FLQQAYEAFESLANFVSQDD

SEQ ID NO: 2872 - protein, 29 aa, synthetic construct
  REGION 1..29: note = Synthetic
KGATKWDSAVESSWAPVLDFVFSTLKNEL

SEQ ID NO: 2873 - protein, 21 aa, synthetic construct
  REGION 1..21: note = Synthetic
KQAKAIIKKVQRKNSEKYKNI

SEQ ID NO: 2874 - protein, 36 aa, synthetic construct
  REGION 1..36: note = Synthetic
ECDRVAANCFHQNKNTYNKNYRFLSSSRCRQTSEQC

SEQ ID NO: 2875 - protein, 36 aa, synthetic construct; identical to SEQ ID NO: 2874
  REGION 1..36: note = Synthetic

SEQ ID NO: 2876 - protein, 15 aa, synthetic construct
  REGION 1..15: note = Synthetic
ELLRRCLDNCEKEHD

SEQ ID NO: 2877 - protein, 18 aa, synthetic construct
  REGION 1..18: note = Synthetic
GALQNLLKVASCKLDKTC

SEQ ID NO: 2878 - protein, 34 aa, synthetic construct
  REGION 1..34: note = Synthetic
KGKQMLKEYANKVLSPEEEAPAAVPAGAPERRRR

SEQ ID NO: 2879 - protein, 23 aa, synthetic construct
  REGION 1..23: note = Synthetic
GRALGKFLQDILWEEVKEAPADK

SEQ ID NO: 2880 - protein, 23 aa, synthetic construct
  REGION 1..23: note = Synthetic
GRALGKFLQDILWEEVKEAPANK

SEQ ID NO: 2881 - protein, 26 aa, synthetic construct
  REGION 1..26: note = Synthetic
IKEAFEDFVKQAEAVQKKVHDAATKQ

SEQ ID NO: 2882 - protein, 19 aa, synthetic construct
  REGION 1..19: note = Synthetic
IIKAAQEAWKIIQQIPRPP

SEQ ID NO: 2883 - protein, 21 aa, synthetic construct
  REGION 1..21: note = Synthetic
TSLKDFLESLKSIMQMDYSQY

SEQ ID NO: 2884 - protein, 23 aa, synthetic construct
  REGION 1..23: note = Synthetic
HAFEFMQRALQDLRKTAYSLDSR

SEQ ID NO: 2885 - protein, 37 aa, synthetic construct
  REGION 1..37: note = Synthetic
NCAKKIVSDGNGMNAWVAWRNRCKGTDVQAWIRGCRL

SEQ ID NO: 2886 - protein, 42 aa, synthetic construct
  REGION 1..42: note = Synthetic
CRKLFGGCVGDGDCCLHLGCKTRKLPPFADPYCAWDWTFGRK

SEQ ID NO: 2887 - protein, 25 aa, synthetic construct
  REGION 1..25: note = Synthetic
IKKAGTELVNFLSYFVELGTQPATQ

SEQ ID NO: 2888 - protein, 25 aa, synthetic construct
  REGION 1..25: note = Synthetic
IKKAGTELVNFLSYFVELGTQPATQ

SEQ ID NO: 2889 - protein, 20 aa, synthetic construct
  REGION 1..20: note = Synthetic
FYDPAKRCCRTCFGCTPCCG

SEQ ID NO: 2890 - protein, 18 aa, synthetic construct
  REGION 1..18: note = Synthetic
LQSFLELAYRVLRYLAEP

SEQ ID NO: 2891 - protein, 25 aa, synthetic construct
  REGION 1..25: note = Synthetic
IKKAGTELVNFLSYFMELGTQPATQ

SEQ ID NO: 2892 - protein, 25 aa, synthetic construct
  REGION 1..25: note = Synthetic
IKKAGTELVNFLSYFMELGTQPATQ

SEQ ID NO: 2893 - protein, 21 aa, synthetic construct
  REGION 1..21: note = Synthetic
LAAFFGLATGLFLGLKAIKLI

SEQ ID NO: 2894 - protein, 25 aa, synthetic construct
  REGION 1..25: note = Synthetic
NMLTFLKSLLEVFQKENVRKMRDRV

SEQ ID NO: 2895 - protein, 40 aa, synthetic construct
  REGION 1..40: note = Synthetic
VGNFVHGFSHVFGDDQQDNGKFYGHYAEDNGKHWYDTGDQ

SEQ ID NO: 2896 - protein, 28 aa, synthetic construct
  REGION 1..28: note = Synthetic
KGGCNRGEQVYGTCSGRLLFCCRRRHRH

SEQ ID NO: 2897 - protein, 20 aa, synthetic construct
  REGION 1..20: note = Synthetic
TAFRQIGNCGHFKVRCCKIR

SEQ ID NO: 2898 - protein, 38 aa, synthetic construct
  REGION 1..38: note = Synthetic
RACRELLGGCSKDSDCCAHLECRKKWPYHCVWDWTIGK

SEQ ID NO: 2899 - protein, 41 aa, synthetic construct
  REGION 1..41: note = Synthetic
RACRELLGGCSKDSDCCAHLECRKKWPYHCVWDWTFGNEKS

SEQ ID NO: 2900 - protein, 28 aa, synthetic construct
  REGION 1..28: note = Synthetic
EAMKEAVERCNNACSEVCTKGSYAVVTA

SEQ ID NO: 2901 - protein, 31 aa, synthetic construct
  REGION 1..31: note = Synthetic
GNKFFRGCAAACPKAEHNEVVRCCARDKCNL

SEQ ID NO: 2902 - protein, 34 aa, synthetic construct
  REGION 1..34: note = Synthetic
LMTSLLEKLQEAVSDGRYVLRIKGIIKNKIKTLK

SEQ ID NO: 2903 - protein, 29 aa, synthetic construct
  REGION 1..29: note = Synthetic
RRVEQFLDYLEEFLRTINIEWNTEWTVES

SEQ ID NO: 2904 - protein, 24 aa, synthetic construct
  REGION 1..24: note = Synthetic
DFITLIYYVVEDVNSLMRGTHGFH

SEQ ID NO: 2905 - protein, 42 aa, synthetic construct
  REGION 1..42: note = Synthetic
CLKNAARGIKGLNAGNAASIPSKCGVSVPYTISASIDCSRVS

SEQ ID NO: 2906 - protein, 42 aa, synthetic construct; identical to SEQ ID NO: 2905
  REGION 1..42: note = Synthetic

SEQ ID NO: 2907 - protein, 21 aa, synthetic construct
  REGION 1..21: note = Synthetic
KAVEFLNKWITFCQSIYSTMT

SEQ ID NO: 2908 - protein, 21 aa, synthetic construct
  REGION 1..21: note = Synthetic
KAVEFLNKWITFCQSIYSTMT

SEQ ID NO: 2909 - protein, 21 aa, synthetic construct
  REGION 1..21: note = Synthetic
KAVEFLNKWITFCQSIYSTMT

SEQ ID NO: 2910 - protein, 21 aa, synthetic construct
  REGION 1..21: note = Synthetic
KAVEFLNKWITFCQSIYSTMT

SEQ ID NO: 2911 - protein, 21 aa, synthetic construct
  REGION 1..21: note = Synthetic
KAVEFLNKWITFCQSIYSTMT

SEQ ID NO: 2912 - protein, 20 aa, synthetic construct
  REGION 1..20: note = Synthetic
NGCRRCCSYAGEAVQTQPGH

SEQ ID NO: 2913 - protein, 40 aa, synthetic construct
  REGION 1..40: note = Synthetic
MLDGLNDYCTGVTPDCPRNPNKGESDELEWSAAATGSVLM

SEQ ID NO: 2914 - protein, 36 aa, synthetic construct
  REGION 1..36: note = Synthetic
ECDRVAANCFHQNKNTYNKEYKFLSSSKCRQRSEQC

SEQ ID NO: 2915 - protein, 18 aa, synthetic construct
  REGION 1..18: note = Synthetic
SAGKTALNKIACKIDKTC

SEQ ID NO: 2916 - protein, 37 aa, synthetic construct
  REGION 1..37: note = Synthetic
NCAKKIVSDGNGMNAWVAWRKHCKGTDVNVWIRGCRL

SEQ ID NO: 2917 - protein, 20 aa, synthetic construct
  REGION 1..20: note = Synthetic
RSCRRCCSYAGEAVQTQPGN

SEQ ID NO: 2918 - protein, 20 aa, synthetic construct
  REGION 1..20: note = Synthetic
RSCRRCCSYAGEAVQTQPGN

SEQ ID NO: 2919 - protein, 21 aa, synthetic construct
  REGION 1..21: note = Synthetic
KAVEFLNKWITFCQSIYSTMT

SEQ ID NO: 2920 - protein, 21 aa, synthetic construct
  REGION 1..21: note = Synthetic
KAVEFLNKWITFCQSIYSTMT

SEQ ID NO: 2921 - protein, 21 aa, synthetic construct
  REGION 1..21: note = Synthetic
KAVEFLNKWITFCQSIYSTMT

SEQ ID NO: 2922 - protein, 21 aa, synthetic construct
  REGION 1..21: note = Synthetic
KAVEFLNKWITFCQSIYSTMT

SEQ ID NO: 2923 - protein, 21 aa, synthetic construct
  REGION 1..21: note = Synthetic
KAVEFLNKWITFCQSIYSTMT

SEQ ID NO: 2924 - protein, 11 aa, synthetic construct
  REGION 1..11: note = Synthetic
TCVASIVRQAA

SEQ ID NO: 2925 - protein, 35 aa, synthetic construct
  REGION 1..35: note = Synthetic
EEIIRLYSNGLRLQQTMSALICLLTFLLELCCWQL

SEQ ID NO: 2926 - protein, 17 aa, synthetic construct
  REGION 1..17: note = Synthetic
FLNKWITFCQSIYSTMT

SEQ ID NO: 2927 - protein, 22 aa, synthetic construct
  REGION 1..22: note = Synthetic
SNFKELVDSLLQVLNVKEGTPS

SEQ ID NO: 2928 - protein, 34 aa, synthetic construct
  REGION 1..34: note = Synthetic
LANFISSLTAGGLVVLTIAVALIVISRTDRVTRF

SEQ ID NO: 2929 - protein, 20 aa, synthetic construct
  REGION 1..20: note = Synthetic
IFKTLLSAVGSALSSSGGQE

SEQ ID NO: 2930 - protein, 34 aa, synthetic construct
  REGION 1..34: note = Synthetic
KRFGKKYPRGCAATCPEAKPHEIVECCSTDKCNK

SEQ ID NO: 2931 - protein, 34 aa, synthetic construct; identical to SEQ ID NO: 2930
  REGION 1..34: note = Synthetic

SEQ ID NO: 2932 - protein, 26 aa, synthetic construct
  REGION 1..26: note = Synthetic
RGLWSTIKNVGKEAAIAAGKAALGAL

SEQ ID NO: 2933 - protein, 29 aa, synthetic construct
  REGION 1..29: note = Synthetic
RGLWSTIKNVGKEAAIAAGKAALGALGEQ

SEQ ID NO: 2934 - protein, 29 aa, synthetic construct
  REGION 1..29: note = Synthetic
RGLWSTIKNVGKEAAIAAGKAVLGSLGEQ

SEQ ID NO: 2935 - protein, 32 aa, synthetic construct
  REGION 1..32: note = Synthetic
GKRGLSDLYDLDEMFDGEISQADIDFLKELMR

SEQ ID NO: 2936 - protein, 25 aa, synthetic construct
  REGION 1..25: note = Synthetic
WLAGCPSGWHNCKSSGPNIGWCCKK

SEQ ID NO: 2937 - protein, 25 aa, synthetic construct
  REGION 1..25: note = Synthetic
RKVEQFLDYLEDFLRTVNTEWTIES

SEQ ID NO: 2938 - protein, 19 aa, synthetic construct
  REGION 1..19: note = Synthetic
KWVQDYMNHLDQKSQAQKP

SEQ ID NO: 2939 - protein, 22 aa, synthetic construct
  REGION 1..22: note = Synthetic
AVDVLSRLVNRATSLGILQQLH

SEQ ID NO: 2940 - protein, 18 aa, synthetic construct
  REGION 1..18: note = Synthetic
AKKAVGKCDDFKCNCIKL

SEQ ID NO: 2941 - protein, 17 aa, synthetic construct
  REGION 1..17: note = Synthetic
LESILQGFPRMKLSAEA

SEQ ID NO: 2942 - protein, 26 aa, synthetic construct
  REGION 1..26: note = Synthetic
KRFLSTLLNVASKVVPTLFCKITKKC

SEQ ID NO: 2943 - protein, 15 aa, synthetic construct
  REGION 1..15: note = Synthetic
QCCANFCRKATSTCM

SEQ ID NO: 2944 - protein, 16 aa, synthetic construct
  REGION 1..16: note = Synthetic
HHITTVMEHLIKELYG

SEQ ID NO: 2945 - protein, 20 aa, synthetic construct
  REGION 1..20: note = Synthetic
LFKTLLSAVGSALSSSGGQE

SEQ ID NO: 2946 - protein, 19 aa, synthetic construct
  REGION 1..19: note = Synthetic
GREYEEYAQKVHSGLPFIE

SEQ ID NO: 2947 - protein, 19 aa, synthetic construct
  REGION 1..19: note = Synthetic
GREYEEYAQKVHSGLPFIE

SEQ ID NO: 2948 - protein, 22 aa, synthetic construct
  REGION 1..22: note = Synthetic
LLNSMRTFISDLEEWDREQYDR

SEQ ID NO: 2949 - protein, 30 aa, synthetic construct
  REGION 1..30: note = Synthetic
THLSELLEEVCKSMSDYALHLDPDTQQKKY

SEQ ID NO: 2950 - protein, 20 aa, synthetic construct
  REGION 1..20: note = Synthetic
FIGTALGIASAIPAIVKLFK

SEQ ID NO: 2951 - protein, 32 aa, synthetic construct
  REGION 1..32: note = Synthetic
EYFIKKIRRVVENVAKAVVINKAVGAVAGTIG

SEQ ID NO: 2952 - protein, 27 aa, synthetic construct
  REGION 1..27: note = Synthetic
MLDGLNDYCTGISSDCPRNRYKGKEDD

SEQ ID NO: 2953 - protein, 15 aa, synthetic construct
  REGION 1..15: note = Synthetic
LKKVKTLLNDIRRMM

SEQ ID NO: 2954 - protein, 18 aa, synthetic construct
  REGION 1..18: note = Synthetic
DKIIAVAKEMGKAGLQAA

SEQ ID NO: 2955 - protein, 20 aa, synthetic construct
  REGION 1..20: note = Synthetic
RGCSRCCSYAGEAVQTQPGH

SEQ ID NO: 2956 - protein, 21 aa, synthetic construct
  REGION 1..21: note = Synthetic
RRVQRCIERLEQNSQPRTYKQ

SEQ ID NO: 2957 - protein, 37 aa, synthetic construct
  REGION 1..37: note = Synthetic
NKAAGAINKFVADKIGVTPSQAASMTLDEIVDAMYYD

SEQ ID NO: 2958 - protein, 20 aa, synthetic construct
  REGION 1..20: note = Synthetic
LARYYTALRHYINLITRQRY

SEQ ID NO: 2959 - protein, 21 aa, synthetic construct
  REGION 1..21: note = Synthetic
RIAHECCKEGCTYDDILDYCA

SEQ ID NO: 2960 - protein, 42 aa, synthetic construct
  REGION 1..42: note = Synthetic
VWDWIKSAAKKIWSSEPVSQLKGQVLNAAKNYVAEKIGATPT

SEQ ID NO: 2961 - protein, 11 aa, synthetic construct
  REGION 1..11: note = Synthetic
ACGGKYFKCGR

SEQ ID NO: 2962 - protein, 20 aa, synthetic construct
  REGION 1..20: note = Synthetic
RGCSRCCSYAGEAVQTQPGH

SEQ ID NO: 2963 - protein, 12 aa, synthetic construct
  REGION 1..12: note = Synthetic
DNGKHWYDTGDQ

SEQ ID NO: 2964 - protein, 20 aa, synthetic construct
  REGION 1..20: note = Synthetic
LAKYYTALRHYINLITRQRY

SEQ ID NO: 2965 - protein, 20 aa, synthetic construct
  REGION 1..20: note = Synthetic
LAKYYTALRHYINLITRQRY

SEQ ID NO: 2966 - protein, 20 aa, synthetic construct
  REGION 1..20: note = Synthetic
LAKYYTALRHYINLITRQRY

SEQ ID NO: 2967 - protein, 21 aa, synthetic construct
  REGION 1..21: note = Synthetic
NAVEFLNKWITFCQSIYSTMT

SEQ ID NO: 2968 - protein, 42 aa, synthetic construct
  REGION 1..42: note = Synthetic
IQGAARALGSRLNAGRAARLPGACRVRISYPISARTNCNTVR

SEQ ID NO: 2969 - protein, 17 aa, synthetic construct
  REGION 1..17: note = Synthetic
FLNKWITFCQSIYSTLT

SEQ ID NO: 2970 - protein, 33 aa, synthetic construct
  REGION 1..33: note = Synthetic
SVNNFCQYFIYSLKQKDNFFMIIFTMLNCLIII

SEQ ID NO: 2971 - protein, 42 aa, synthetic construct
  REGION 1..42: note = Synthetic
CHRACGSCCAKCQCVPPGTSGNTASCPCYASIRTHGNKLKCP

SEQ ID NO: 2972 - protein, 39 aa, synthetic construct
  REGION 1..39: note = Synthetic
CEKGFQCCSSFCGIVCSSETFQKRNRIKHKGSEVIMPAN

SEQ ID NO: 2973 - protein, 22 aa, synthetic construct
  REGION 1..22: note = Synthetic
ARMATKLGRKVLNKRRQKGENS

SEQ ID NO: 2974 - protein, 14 aa, synthetic construct
  REGION 1..14: note = Synthetic
EAVKKLLEALSHLV

SEQ ID NO: 2975 - protein, 27 aa, synthetic construct
  REGION 1..27: note = Synthetic
ASMEKLMERGFNESMRLSPGGPDPRHH

SEQ ID NO: 2976 - protein, 23 aa, synthetic construct
  REGION 1..23: note = Synthetic
LPAIVGAAGQFLPKIFCAISKKC

SEQ ID NO: 2977 - protein, 42 aa, synthetic construct
  REGION 1..42: note = Synthetic
ITQAVACAKRVVSDPNGIRAWVAWRAHCENQDVSQYVRNCGV

SEQ ID NO: 2978 - protein, 42 aa, synthetic construct; identical to SEQ ID NO: 2977
  REGION 1..42: note = Synthetic

SEQ ID NO: 2979 - protein, 34 aa, synthetic construct
  REGION 1..34: note = Synthetic
TGVFNIIKTIGKEAGMDVIRAGIDTISCKIKGEC

SEQ ID NO: 2980 - protein, 17 aa, synthetic construct
  REGION 1..17: note = Synthetic
LFDVIKKVASVIGLASP

SEQ ID NO: 2981 - protein, 22 aa, synthetic construct
  REGION 1..22: note = Synthetic
GDDMNDYCTGITPDCPRNPYKD

SEQ ID NO: 2982 - protein, 22 aa, synthetic construct
  REGION 1..22: note = Synthetic
RGLLSGILGAGKNIVCGLSGLC

SEQ ID NO: 2983 - protein, 22 aa, synthetic construct
  REGION 1..22: note = Synthetic
RGLLSGILGAGKNIVCGLSGLC

SEQ ID NO: 2984 - protein, 20 aa, synthetic construct
  REGION 1..20: note = Synthetic
ITEFLNKWITFCQSIFSTLT

SEQ ID NO: 2985 - protein, 19 aa, synthetic construct
  REGION 1..19: note = Synthetic
RLYELLHGAGNHAAGILTL

SEQ ID NO: 2986 - protein, 18 aa, synthetic construct
  REGION 1..18: note = Synthetic
KWIQEYLEKALNKKAKKT

SEQ ID NO: 2987 - protein, 20 aa, synthetic construct
  REGION 1..20: note = Synthetic
MAHYAAELRRYINMLTRPRY

SEQ ID NO: 2988 - protein, 20 aa, synthetic construct
  REGION 1..20: note = Synthetic
NGCRRCCSYAGEAVQTQPGH

SEQ ID NO: 2989 - protein, 14 aa, synthetic construct
  REGION 1..14: note = Synthetic
EAVKKLLEALSHLV

SEQ ID NO: 2990 - protein, 29 aa, synthetic construct
  REGION 1..29: note = Synthetic
EEANHAVDRCNEACRRFCTKEAETVTAVS

SEQ ID NO: 2991 - protein, 35 aa, synthetic construct
  REGION 1..35: note = Synthetic
CDKIAANCFAANLKTYNKKLRFYNKFRCRGAAPAC

SEQ ID NO: 2992 - protein, 17 aa, synthetic construct
  REGION 1..17: note = Synthetic
LSDVIDEYVSNVQMVGK

SEQ ID NO: 2993 - protein, 17 aa, synthetic construct
  REGION 1..17: note = Synthetic
LSDVIDEYVSNVQMVGK

SEQ ID NO: 2994 - protein, 41 aa, synthetic construct
  REGION 1..41: note = Synthetic
VTKYCNQVTGALVAGLIALITYIILLLHSIYTFLNPLLEKA

SEQ ID NO: 2995 - protein, 21 aa, synthetic construct
  REGION 1..21: note = Synthetic
ACNAALAKLEKIADDINDDDD

SEQ ID NO: 2996 - protein, 20 aa, synthetic construct
  REGION 1..20: note = Synthetic
LNRYYASLRHYLNLVTRQRY

SEQ ID NO: 2997 - protein, 42 aa, synthetic construct
  REGION 1..42: note = Synthetic
YCGKGPKYCGRASTTVDHQADVAATKTAKNPTDAKLAGAGSP

SEQ ID NO: 2998 - protein, 33 aa, synthetic construct
  REGION 1..33: note = Synthetic
KNWSEFVRSMLRAMSKVAAYILQEKHNHDDDDE

SEQ ID NO: 2999 - protein, 24 aa, synthetic construct
  REGION 1..24: note = Synthetic
AVSQCTNACSNFCTKGSAKAVETA

SEQ ID NO: 3000 - protein, 22 aa, synthetic construct
  REGION 1..22: note = Synthetic
WFDPVKRCCSRYCWKCIPCCPY

SEQ ID NO: 3001 - protein, 20 aa, synthetic construct
  REGION 1..20: note = Synthetic
NGCSRCCSYAGEAVQTQPGH

SEQ ID NO: 3002 - protein, 12 aa, synthetic construct
  REGION 1..12: note = Synthetic
CGWVQDAYKGIV

SEQ ID NO: 3003 - protein, 32 aa, synthetic construct
  REGION 1..32: note = Synthetic
KKLGDSAISCGETCFKFKCYTPRCSCSYPVCK

SEQ ID NO: 3004 - protein, 17 aa, synthetic construct
  REGION 1..17: note = Synthetic
LNALLHHGLNCAKGVLA

SEQ ID NO: 3005 - protein, 19 aa, synthetic construct
  REGION 1..19: note = Synthetic
FEQLVEKIKSLWYTRVLGY

SEQ ID NO: 3006 - protein, 23 aa, synthetic construct
  REGION 1..23: note = Synthetic
KGYHGCSRCCSYAGEAVQTQSGH

SEQ ID NO: 3007 - protein, 14 aa, synthetic construct
  REGION 1..14: note = Synthetic
GMNAIENMFSFCFR

SEQ ID NO: 3008 - protein, 42 aa, synthetic construct
  REGION 1..42: note = Synthetic
ACRCLQSAAKGVNPSLASGLPGKCGVSIPYPISTSTNCATIK

SEQ ID NO: 3009 - protein, 20 aa, synthetic construct
  REGION 1..20: note = Synthetic
MARYYSALRHYINLITRQRY

SEQ ID NO: 3010 - protein, 20 aa, synthetic construct
  REGION 1..20: note = Synthetic
MARYYSALRHYINLITRQRY

SEQ ID NO: 3011 - protein, 20 aa, synthetic construct
  REGION 1..20: note = Synthetic
MARYYSALRHYINLITRQRY

SEQ ID NO: 3012 - protein, 21 aa, synthetic construct
  REGION 1..21: note = Synthetic
KNINEFLKSFIHIVQMFINPS

SEQ ID NO: 3013 - protein, 20 aa, synthetic construct
  REGION 1..20: note = Synthetic
NDMCYKLTSLLSRCYPKKSE

SEQ ID NO: 3014 - protein, 16 aa, synthetic construct
  REGION 1..16: note = Synthetic
WNRCFARIANGISAGL

SEQ ID NO: 3015 - protein, 42 aa, synthetic construct
  REGION 1..42: note = Synthetic
CYGAAGTCARIVCDCDRTAALCFGNSEYIERHKNIDTKRHCR

SEQ ID NO: 3016 - protein, 14 aa, synthetic construct
  REGION 1..14: note = Synthetic
EAVKKLLEALSHLV

SEQ ID NO: 3017 - protein, 20 aa, synthetic construct
  REGION 1..20: note = Synthetic
MAKYYSALRHYINLITRQRY

SEQ ID NO: 3018 - protein, 20 aa, synthetic construct
  REGION 1..20: note = Synthetic
MAKYYSALRHYINLITRQRY

SEQ ID NO: 3019 - protein, 18 aa, synthetic construct
  REGION 1..18: note = Synthetic
LKCCKSMCGKVCLTPVKA

SEQ ID NO: 3020 - protein, 20 aa, synthetic construct
  REGION 1..20: note = Synthetic
SLCSTLLNHCMTLLNCCAWL

SEQ ID NO: 3021 - protein, 20 aa, synthetic construct
  REGION 1..20: note = Synthetic
KAERMVRRAAKQAEEEADQR

SEQ ID NO: 3022 - protein, 36 aa, synthetic construct
  REGION 1..36: note = Synthetic
GEGLCDNLCKYEGAISGVCVSDPHRCLCRNRKPGCS

SEQ ID NO: 3023 - protein, 20 aa, synthetic construct
  REGION 1..20: note = Synthetic
MNKYLTALRHYINLVTRQRY

SEQ ID NO: 3024 - protein, 23 aa, synthetic construct
  REGION 1..23: note = Synthetic
KALSSLCEIASEACSAWFPLPDN

SEQ ID NO: 3025 - protein, 38 aa, synthetic construct
  REGION 1..38: note = Synthetic
SWIAGGVERIERGCSLTCPDIKYNGKYIYCCTRDNCNA

SEQ ID NO: 3026 - protein, 33 aa, synthetic construct
  REGION 1..33: note = Synthetic
RGCKGFGDSCTPEKNECCPNYACSSKHKWCKSI

SEQ ID NO: 3027 - protein, 40 aa, synthetic construct
  REGION 1..40: note = Synthetic
RGIRPVGRFGRRRATPRDVTGLGQLSCLPLDGRTKFSQRG

SEQ ID NO: 3028 - protein, 14 aa, synthetic construct
  REGION 1..14: note = Synthetic
EDLCQIADRMIERL

SEQ ID NO: 3029 - protein, 34 aa, synthetic construct
  REGION 1..34: note = Synthetic
TELMTYARDIFQYAGCLIDFEVINIDPSSSGNDD

SEQ ID NO: 3030 - protein, 12 aa, synthetic construct
  REGION 1..12: note = Synthetic
VGGGGGGGSRVI

SEQ ID NO: 3031 - protein, 22 aa, synthetic construct
  REGION 1..22: note = Synthetic
EAGLEALRTGIDVIGCKIKGEC

SEQ ID NO: 3032 - protein, 22 aa, synthetic construct
  REGION 1..22: note = Synthetic
EAGLEALRTGIDVIGCKIKGEC

SEQ ID NO: 3033 - protein, 36 aa, synthetic construct
  REGION 1..36: note = Synthetic
ECDRVAANCFHQNQNTYNKNYKFLSSSRCRQTSEQC

SEQ ID NO: 3034 - protein, 42 aa, synthetic construct
  REGION 1..42: note = Synthetic
KAVAQVKNAVSKLQEKGVYKAMSEFDIFIDYIEAYMTMKTQN

SEQ ID NO: 3035 - protein, 42 aa, synthetic construct; identical to SEQ ID NO: 2977
  REGION 1..42: note = Synthetic

SEQ ID NO: 3036 - protein, 25 aa, synthetic construct
  REGION 1..25: note = Synthetic
GLFSVLGSVAKHLLPHVVPVIAEKL

SEQ ID NO: 3037 - protein, 36 aa, synthetic construct
  REGION 1..36: note = Synthetic
QCDKAAAECFARNKKTYSLKYQFYPNMFCKGKKPKC

SEQ ID NO: 3038 - protein, 27 aa, synthetic construct
  REGION 1..27: note = Synthetic
CANTLMEVWDTLVKYNDGDAKVNKPWL

SEQ ID NO: 3039 - protein, 21 aa, synthetic construct
  REGION 1..21: note = Synthetic
KDIKEFLQSFIRIVQMFINTS

SEQ ID NO: 3040 - protein, 19 aa, synthetic construct
  REGION 1..19: note = Synthetic
AKNALQKFIEEMKKIKNRP

SEQ ID NO: 3041 - protein, 20 aa, synthetic construct
  REGION 1..20: note = Synthetic
TFTQFWSRLCHHAQSLQCLE

SEQ ID NO: 3042 - protein, 36 aa, synthetic construct
  REGION 1..36: note = Synthetic
RDCAGYMRECKEKLCCSGYVCSSRWKWRVLPAPWRR

SEQ ID NO: 3043 - protein, 36 aa, synthetic construct
  REGION 1..36: note = Synthetic
RDCAGYMRECKEKLCCSGYVRSSRWKWCVLPAPWRR

SEQ ID NO: 3044 - protein, 34 aa, synthetic construct
  REGION 1..34: note = Synthetic
FQGCLGTCFNYTKTNNNMVKEHKCCDHQNLCNKP

SEQ ID NO: 3045 - protein, 14 aa, synthetic construct
  REGION 1..14: note = Synthetic
EKLKRVASTFLQKN

SEQ ID NO: 3046 - protein, 29 aa, synthetic construct
  REGION 1..29: note = Synthetic
ADKLTDFINSVMDQLATLGFRNGVDAGLV

SEQ ID NO: 3047 - protein, 20 aa, synthetic construct
  REGION 1..20: note = Synthetic
NGCSRCCSYAGEAVQTQPGH

SEQ ID NO: 3048 - protein, 41 aa, synthetic construct
  REGION 1..41: note = Synthetic
KECLHTCDTCAKAQGKRGNCASEMLKSTRPQGWAVAAFQMG

SEQ ID NO: 3049 - protein, 25 aa, synthetic construct
  REGION 1..25: note = Synthetic
ITTVVRVITDVIDAAVAAGKIFKKP

SEQ ID NO: 3050 - protein, 18 aa, synthetic construct
  REGION 1..18: note = Synthetic
AKKAVGKCDDFKCNCIKL

SEQ ID NO: 3051 - protein, 27 aa, synthetic construct
  REGION 1..27: note = Synthetic
SARKLLQDIMNRQQGERNQEQGAKVRL

SEQ ID NO: 3052 - protein, 27 aa, synthetic construct
  REGION 1..27: note = Synthetic
SARKLLQDIMNRQQGERNQEQGAKVRL

SEQ ID NO: 3053 - protein, 15 aa, synthetic construct
  REGION 1..15: note = Synthetic
IDYIRDICQKVLKEL

SEQ ID NO: 3054 - protein, 24 aa, synthetic construct
  REGION 1..24: note = Synthetic
YKCGARIGRNCFCLQKGVIYKREN

SEQ ID NO: 3055 - protein, 23 aa, synthetic construct
  REGION 1..23: note = Synthetic
SFPSVLSSCCKGMSHGQHFHTHT

SEQ ID NO: 3056 - protein, 12 aa, synthetic construct
  REGION 1..12: note = Synthetic
INAVSTLVHHFG

SEQ ID NO: 3057 - protein, 12 aa, synthetic construct
  REGION 1..12: note = Synthetic
INAVSTLVHHFG

SEQ ID NO: 3058 - protein, 16 aa, synthetic construct
  REGION 1..16: note = Synthetic
KLLKTVAKQAAKKQME

SEQ ID NO: 3059 - protein, 23 aa, synthetic construct
  REGION 1..23: note = Synthetic
MGGLIKAATKALPAAFCAITKKC

SEQ ID NO: 3060 - protein, 26 aa, synthetic construct
  REGION 1..26: note = Synthetic
VASGINTWAKDLKDIAEKEEREKASL

SEQ ID NO: 3061 - protein, 42 aa, synthetic construct
  REGION 1..42: note = Synthetic
KAVEQVMNAFSKLQEKGVYKAMSEFDIFINYIEAYMTMKIQN

SEQ ID NO: 3062 - protein, 20 aa, synthetic construct
  REGION 1..20: note = Synthetic
RGCSRCCSYAGEAVQTQPGH

SEQ ID NO: 3063 - protein, 23 aa, synthetic construct
  REGION 1..23: note = Synthetic
DHVLDLLEDACDGLYDHLVSSKK

SEQ ID NO: 3064 - protein, 39 aa, synthetic construct
  REGION 1..39: note = Synthetic
GGGGGGGARRMKGLAKKAMGKGCFGHKLDRIGSTSGLGC

SEQ ID NO: 3065 - protein, 27 aa, synthetic construct
  REGION 1..27: note = Synthetic
VRSAGTSLVNFFSSLMNLEEKPAPAAK

SEQ ID NO: 3066 - protein, 35 aa, synthetic construct
  REGION 1..35: note = Synthetic
ECDRVAATCFRDNLNTYDKKYRKYPPSQCTGTEQC

SEQ ID NO: 3067 - protein, 22 aa, synthetic construct
  REGION 1..22: note = Synthetic
RLGRQLHNIVDKPRQNFNDPRF

SEQ ID NO: 3068 - protein, 31 aa, synthetic construct
  REGION 1..31: note = Synthetic
AWGLWSSVVKSWGFRAGETEAPISALSSAHA

SEQ ID NO: 3069 - protein, 26 aa, synthetic construct
  REGION 1..26: note = Synthetic
CWGPCTGGFRQIGTCGLPRVRCCKKK

SEQ ID NO: 3070 - protein, 17 aa, synthetic construct
  REGION 1..17: note = Synthetic
RELPKVCRNIFSRVSLI

SEQ ID NO: 3071 - protein, 35 aa, synthetic construct
  REGION 1..35: note = Synthetic
VKRFKKFFRKLKKSVKKRVKKFFKKPRVIGVTIPF

SEQ ID NO: 3072 - protein, 29 aa, synthetic construct
  REGION 1..29: note = Synthetic
DCYGRYKSGARRGRNCFCLQKGVIYKREN

SEQ ID NO: 3073 - protein, 32 aa, synthetic construct
  REGION 1..32: note = Synthetic
SKIPELFRDFARSLSAPIIDSFDEAIETYKLF

SEQ ID NO: 3074 - protein, 28 aa, synthetic construct
  REGION 1..28: note = Synthetic
DNVEHAWNDAFDKMYYVIFANLDGHPVA

SEQ ID NO: 3075 - protein, 25 aa, synthetic construct
  REGION 1..25: note = Synthetic
QECQDCCKNAGHNGGTCMFFKCKCA

SEQ ID NO: 3076 - protein, 17 aa, synthetic construct
  REGION 1..17: note = Synthetic
FLNKWITFCQSIYSTLT

SEQ ID NO: 3077 - protein, 25 aa, synthetic construct
  REGION 1..25: note = Synthetic
VKKAGTDLVNFLSYFVELRTQPATQ

SEQ ID NO: 3078 - protein, 26 aa, synthetic construct
  REGION 1..26: note = Synthetic
QECQDCCKNAGHNGGTCVYYKCKCNP

SEQ ID NO: 3079 - protein, 20 aa, synthetic construct
  REGION 1..20: note = Synthetic
IAQYFSALRHYINLVTRQRY

SEQ ID NO: 3080 - protein, 32 aa, synthetic construct
  REGION 1..32: note = Synthetic
QRCNRWCHNGCGNGKGGYYKSMSHGGQCHYYC

SEQ ID NO: 3081 - protein, 26 aa, synthetic construct
  REGION 1..26: note = Synthetic
QLVKQLLQEWSIMKLWVTLLPEFTNF

SEQ ID NO: 3082 - protein, 30 aa, synthetic construct
  REGION 1..30: note = Synthetic
RFLEGVISTIKDFAGKVCCSVSVNFCCPTA

SEQ ID NO: 3083 - protein, 22 aa, synthetic construct
  REGION 1..22: note = Synthetic
YDDFVKHAEEVQKKLHEAATKQ

SEQ ID NO: 3084 - protein, 29 aa, synthetic construct
  REGION 1..29: note = Synthetic
EEANDAVESCDQACSSFCNVHVGAATVVA

SEQ ID NO: 3085 - protein, 29 aa, synthetic construct
  REGION 1..29: note = Synthetic
EEANDAVESCDQACSSFCSVHVGSATVVA

SEQ ID NO: 3086 - protein, 34 aa, synthetic construct
  REGION 1..34: note = Synthetic
KSYANWGSSAEKTFNAGNLELAGKFPGETRSCFN

SEQ ID NO: 3087 - protein, 16 aa, synthetic construct
  REGION 1..16: note = Synthetic
DLIQLIHKLLKVRDYD

SEQ ID NO: 3088 - protein, 27 aa, synthetic construct
  REGION 1..27: note = Synthetic
DMCEILSSVLSVAYRTQYSRMEREKGV

SEQ ID NO: 3089 - protein, 36 aa, synthetic construct
  REGION 1..36: note = Synthetic
RDCAGYMRECKEKLCCSGYVCSSRWKRCVLPAPWRR

SEQ ID NO: 3090 - protein, 21 aa, synthetic construct
  REGION 1..21: note = Synthetic
GLLGSLFGAGKKVACALSGLC

SEQ ID NO: 3091 - protein, 40 aa, synthetic construct
  REGION 1..40: note = Synthetic
GGVHRCYEPCEKKKCRLPHKCINGRCTCYVGRNVCAISSH

SEQ ID NO: 3092 - protein, 40 aa, synthetic construct; identical to SEQ ID NO: 3091
  REGION 1..40: note = Synthetic

SEQ ID NO: 3093 - protein, 11 aa, synthetic construct
  REGION 1..11: note = Synthetic
GRGGASNYVRL

SEQ ID NO: 3094 - protein, 11 aa, synthetic construct
  REGION 1..11: note = Synthetic
GRGGASNYVRL

SEQ ID NO: 3095 - protein, 11 aa, synthetic construct
  REGION 1..11: note = Synthetic
GRGGASNYVRL

SEQ ID NO: 3096 - protein, 11 aa, synthetic construct
  REGION 1..11: note = Synthetic
GRGGASNYVRL

SEQ ID NO: 3097 - protein, 11 aa, synthetic construct
  REGION 1..11: note = Synthetic
GRGGASNYVRL

SEQ ID NO: 3098 - protein, 11 aa, synthetic construct
  REGION 1..11: note = Synthetic
GRGGASNYVRL

SEQ ID NO: 3099 - protein, 11 aa, synthetic construct
  REGION 1..11: note = Synthetic
GRGGASNYVRL

SEQ ID NO: 3100 - protein, 11 aa, synthetic construct
  REGION 1..11: note = Synthetic
GRGGASNYVRL

SEQ ID NO: 3101 - protein, 14 aa, synthetic construct
  REGION 1..14: note = Synthetic
IRSILDYISKLLGE

SEQ ID NO: 3102 - protein, 24 aa, synthetic construct
  REGION 1..24: note = Synthetic
DNVAAAWTHALDNVYTAVFQIVTA

SEQ ID NO: 3103 - protein, 34 aa, synthetic construct
  REGION 1..34: note = Synthetic
TCSKLVSSLVEIADQLDDDLNASPGDLCKFVYFC

SEQ ID NO: 3104 - protein, 16 aa, synthetic construct
  REGION 1..16: note = Synthetic
KVLKTVAKQAAKKQME

SEQ ID NO: 3105 - protein, 42 aa, synthetic construct
  REGION 1..42: note = Synthetic
IADAVTCAKRVVSDPQGIRAWVAWRNHCQNRDVSQYVQGCGV

SEQ ID NO: 3106 - protein, 40 aa, synthetic construct
  REGION 1..40: note = Synthetic
KKGGGHCQAYIGRSHGRLAIENYCCCNNYSNSPISSPVMN

SEQ ID NO: 3107 - protein, 14 aa, synthetic construct
  REGION 1..14: note = Synthetic
LESLAKGIVSGIQA

SEQ ID NO: 3108 - protein, 38 aa, synthetic construct
  REGION 1..38: note = Synthetic
FNPCERGGDRGCTVFCKRKLVTRGECRDEGCWCCPGQV

SEQ ID NO: 3109 - protein, 21 aa, synthetic construct
  REGION 1..21: note = Synthetic
EFIENFQDIARRLHREEKWEK

SEQ ID NO: 3110 - protein, 24 aa, synthetic construct
  REGION 1..24: note = Synthetic
AVSQCTNACSNFCTKGSAKAVETA

SEQ ID NO: 3111 - protein, 29 aa, synthetic construct
  REGION 1..29: note = Synthetic
FHDCEDAARELQSQIQEARADLTRRGLRF

SEQ ID NO: 3112 - protein, 18 aa, synthetic construct
  REGION 1..18: note = Synthetic
KFLAEIIDTCNERLDEIL

SEQ ID NO: 3113 - protein, 39 aa, synthetic construct
  REGION 1..39: note = Synthetic
EYLGDLARKFKCTISWNYDIRFIVQYKVQRVILITHLNV

SEQ ID NO: 3114 - protein, 39 aa, synthetic construct
  REGION 1..39: note = Synthetic
KCMTGICKKVDSHPTCFCGGCSNANDVSLDTLISQLPHN

SEQ ID NO: 3115 - protein, 37 aa, synthetic construct
  REGION 1..37: note = Synthetic
NRLEGWLARAERMVKNTFMPTDVDPEAFGHQHKELAA

SEQ ID NO: 3116 - protein, 26 aa, synthetic construct
  REGION 1..26: note = Synthetic
TTAVSALRSCVSILTTMVAYKMVVGN

SEQ ID NO: 3117 - protein, 28 aa, synthetic construct
  REGION 1..28: note = Synthetic
VTTYADFIDSLKTFLTDIPFECKKPGQK

SEQ ID NO: 3118 - protein, 20 aa, synthetic construct
  REGION 1..20: note = Synthetic
RHFGNACEKIVHTCQTGEST

SEQ ID NO: 3119 - protein, 24 aa, synthetic construct
  REGION 1..24: note = Synthetic
YKSGARIGRNCFCLQKGVIYKREN

SEQ ID NO: 3120 - protein, 12 aa, synthetic construct
  REGION 1..12: note = Synthetic
ANANSFISQVNK

SEQ ID NO: 3121 - protein, 17 aa, synthetic construct
  REGION 1..17: note = Synthetic
FFQEFITFCQRLIQLTR

SEQ ID NO: 3122 - protein, 17 aa, synthetic construct
  REGION 1..17: note = Synthetic
FLNKWITFCQSIYSTMT

SEQ ID NO: 3123 - protein, 36 aa, synthetic construct
  REGION 1..36: note = Synthetic
RNCAGYMRECKEKLCCSGYVCSSRWKWCVLPAPWRR

SEQ ID NO: 3124 - protein, 21 aa, synthetic construct
  REGION 1..21: note = Synthetic
IESAWNVIEEFLKTVKSQMNM

SEQ ID NO: 3125 - protein, 18 aa, synthetic construct
  REGION 1..18: note = Synthetic
RDAGRLLRSLKKLKLTTH

SEQ ID NO: 3126 - protein, 23 aa, synthetic construct
  REGION 1..23: note = Synthetic
NRFLNNISSLFERMTSFFGGAGP

SEQ ID NO: 3127 - protein, 17 aa, synthetic construct
  REGION 1..17: note = Synthetic
LFDIIKKVASVVGLASP

SEQ ID NO: 3128 - protein, 18 aa, synthetic construct
  REGION 1..18: note = Synthetic
LQSFLELAYRVLRYLAEP

SEQ ID NO: 3129 - protein, 24 aa, synthetic construct
  REGION 1..24: note = Synthetic
GLFGVLGSIAKHVLPHVVPVIAEK

SEQ ID NO: 3130 - protein, 20 aa, synthetic construct
  REGION 1..20: note = Synthetic
LSRYYASLRHYLNLVTRQRY

SEQ ID NO: 3131 - protein, 20 aa, synthetic construct
  REGION 1..20: note = Synthetic
LSRYYASLRHYLNLVTRQRY

SEQ ID NO: 3132 - protein, 14 aa, synthetic construct
  REGION 1..14: note = Synthetic
CKSYYSIVADCCNQ

SEQ ID NO: 3133 - protein, 14 aa, synthetic construct
  REGION 1..14: note = Synthetic
CKSYYSIVADCCNQ

SEQ ID NO: 3134 - protein, 14 aa, synthetic construct
  REGION 1..14: note = Synthetic
CKSYYSIVADCCNQ

SEQ ID NO: 3135 - protein, 14 aa, synthetic construct
  REGION 1..14: note = Synthetic
CKSYYSIVADCCNQ

SEQ ID NO: 3136 - protein, 14 aa, synthetic construct
  REGION 1..14: note = Synthetic
CKSYYSIVADCCNQ

SEQ ID NO: 3137 - protein, 14 aa, synthetic construct
  REGION 1..14: note = Synthetic
CKSYYSIVADCCNQ

SEQ ID NO: 3138 - protein, 14 aa, synthetic construct
  REGION 1..14: note = Synthetic
CKSYYSIVADCCNQ

SEQ ID NO: 3139 - protein, 14 aa, synthetic construct
  REGION 1..14: note = Synthetic
CKSYYSIVADCCNQ

SEQ ID NO: 3140 - protein, 14 aa, synthetic construct
  REGION 1..14: note = Synthetic
CKSYYSIVADCCNQ

SEQ ID NO: 3141 - protein, 18 aa, synthetic construct
  REGION 1..18: note = Synthetic
LQSFLELAYRVLRYLAEP

SEQ ID NO: 3142 - protein, 42 aa, synthetic construct
  REGION 1..42: note = Synthetic
IADAVACAKRVVSDPQGIRAWVAWRNHCQNKDVSQYVKGCGV

SEQ ID NO: 3143 - protein, 42 aa, synthetic construct
  REGION 1..42: note = Synthetic
IADAVACAKRVVSDPQGIRAWVAWKKHCQNRDVSQYVEGCGV

SEQ ID NO: 3144 - protein, 42 aa, synthetic construct
  REGION 1..42: note = Synthetic
IADAVACAKRVVSDPQGIRAWVAWRNHCQNRDVSQYVKGCGV

SEQ ID NO: 3145 - protein, 42 aa, synthetic construct; identical to SEQ ID NO: 3142
  REGION 1..42: note = Synthetic

SEQ ID NO: 3146 - protein, 42 aa, synthetic construct; identical to SEQ ID NO: 3142
  REGION 1..42: note = Synthetic

SEQ ID NO: 3147 - protein, 42 aa, synthetic construct; identical to SEQ ID NO: 3143
  REGION 1..42: note = Synthetic

SEQ ID NO: 3148 - protein, 42 aa, synthetic construct; identical to SEQ ID NO: 3142
  REGION 1..42: note = Synthetic

SEQ ID NO: 3149 - protein, 25 aa, synthetic construct
  REGION 1..25: note = Synthetic
VLSAYWRNLNNFHRFSGMGFGPETP

SEQ ID NO: 3150 - protein, 20 aa, synthetic construct
  REGION 1..20: note = Synthetic
MAQYAAELRRYINMLTRPRY

SEQ ID NO: 3151 - protein, 20 aa, synthetic construct
  REGION 1..20: note = Synthetic
MAQYAAELRRYINMLTRPRY

SEQ ID NO: 3152 - protein, 20 aa, synthetic construct
  REGION 1..20: note = Synthetic
MAQYAAELRRYINMLTRPRY

SEQ ID NO: 3153 - protein, 16 aa, synthetic construct
  REGION 1..16: note = Synthetic
WTHGLDNIFGMIFAHL

SEQ ID NO: 3154 - protein, 27 aa, synthetic construct
  REGION 1..27: note = Synthetic
GQEGRQMLQKARNLPSMCGIRPQRCDF

SEQ ID NO: 3155 - protein, 38 aa, synthetic construct; identical to SEQ ID NO: 3025
  REGION 1..38: note = Synthetic

SEQ ID NO: 3156 - protein, 38 aa, synthetic construct; identical to SEQ ID NO: 3025
  REGION 1..38: note = Synthetic

SEQ ID NO: 3157 - protein, 38 aa, synthetic construct; identical to SEQ ID NO: 3025
  REGION 1..38: note = Synthetic

SEQ ID NO: 3158 - protein, 38 aa, synthetic construct; identical to SEQ ID NO: 3025
  REGION 1..38: note = Synthetic

SEQ ID NO: 3159 - protein, 23 aa, synthetic construct
  REGION 1..23: note = Synthetic
CNEGWDKCASYYSPIAECCRKKK

SEQ ID NO: 3160 - protein, 37 aa, synthetic construct
  REGION 1..37: note = Synthetic
RCLSPMNHLCHKDADCSGKKRCCSSACGRDCRDPVRG

SEQ ID NO: 3161 - protein, 14 aa, synthetic construct
  REGION 1..14: note = Synthetic
EAVKKLLEALSHLV

SEQ ID NO: 3162 - protein, 26 aa, synthetic construct
  REGION 1..26: note = Synthetic
RDFRGVVDSCCRKSCSFSTLRAYCDS

SEQ ID NO: 3163 - protein, 27 aa, synthetic construct
  REGION 1..27: note = Synthetic
KELGKVIEGFISGVEDIISGASGTVRP

SEQ ID NO: 3164 - protein, 24 aa, synthetic construct
  REGION 1..24: note = Synthetic
AVDRCNEACYRFCTNEAEIVTVAS

SEQ ID NO: 3165 - protein, 24 aa, synthetic construct
  REGION 1..24: note = Synthetic
RSVYSAADKVANALRFGGKNIILL

SEQ ID NO: 3166 - protein, 33 aa, synthetic construct
  REGION 1..33: note = Synthetic
EDIEKLIEEIKKKLAGYMDVTGEQNEEEEKKEL

SEQ ID NO: 3167 - protein, 24 aa, synthetic construct
  REGION 1..24: note = Synthetic
YKSGARIGRNCFCLQKGVIYKREN

SEQ ID NO: 3168 - protein, 24 aa, synthetic construct
  REGION 1..24: note = Synthetic
RKLYHRVGTCIQNIFYQLLLTVNY

SEQ ID NO: 3169 - protein, 37 aa, synthetic construct
  REGION 1..37: note = Synthetic
RCLSPMNHLCHKDSDCSGKKRCCHSACGRDCRDPARG

SEQ ID NO: 3170 - protein, 37 aa, synthetic construct; identical to SEQ ID NO: 3169
  REGION 1..37: note = Synthetic

SEQ ID NO: 3171 - protein, 37 aa, synthetic construct; identical to SEQ ID NO: 3169
  REGION 1..37: note = Synthetic

SEQ ID NO: 3172 - protein, 34 aa, synthetic construct
  REGION 1..34: note = Synthetic
WSRWWSSCWRLWTRIYLVELQLLNLAPGVSSGVK

SEQ ID NO: 3173 - protein, 34 aa, synthetic construct
  REGION 1..34: note = Synthetic
RALKQADYLLDNVVRANLKGALPSATPVPPGSYT

SEQ ID NO: 3174 - protein, 42 aa, synthetic construct
  REGION 1..42: note = Synthetic
KAVEQVKNAFSKLQEKGVYKAMSEFDIFINYIEAYMTMKIQN

SEQ ID NO: 3175 - protein, 42 aa, synthetic construct; identical to SEQ ID NO: 3174
  REGION 1..42: note = Synthetic

SEQ ID NO: 3176 - protein, 42 aa, synthetic construct; identical to SEQ ID NO: 3174
  REGION 1..42: note = Synthetic

SEQ ID NO: 3177 - protein, 36 aa, synthetic construct
  REGION 1..36: note = Synthetic
QCDKAAAECFARNKKSYSLKYQFYPNKFCKGKTPSC

SEQ ID NO: 3178 - protein, 35 aa, synthetic construct
  REGION 1..35: note = Synthetic
HEVLGAFWKMARVGERASPYVSLACILMAISQFNS

SEQ ID NO: 3179 - protein, 31 aa, synthetic construct
  REGION 1..31: note = Synthetic
MARGVAQLNTYYVNLTNGDAIVEYNVTLYHY

SEQ ID NO: 3180 - protein, 14 aa, synthetic construct
  REGION 1..14: note = Synthetic
FDKYARAIQTVGKK

SEQ ID NO: 3181 - protein, 22 aa, synthetic construct
  REGION 1..22: note = Synthetic
LANIYEDYRSGFKSGIGARPGR

SEQ ID NO: 3182 - protein, 12 aa, synthetic construct
  REGION 1..12: note = Synthetic
GQAALNAASEAL

SEQ ID NO: 3183 - protein, 20 aa, synthetic construct
  REGION 1..20: note = Synthetic
MAQYAADLRRYINMLTRPRY

SEQ ID NO: 3184 - protein, 33 aa, synthetic construct
  REGION 1..33: note = Synthetic
VEACESVADTVFNAVWTLGCRPFMNSQRSACIC

SEQ ID NO: 3185 - protein, 17 aa, synthetic construct
  REGION 1..17: note = Synthetic
AHTFATKLMKCIDDNLI

SEQ ID NO: 3186 - protein, 14 aa, synthetic construct
  REGION 1..14: note = Synthetic
EAVKKLLEALSHLV

SEQ ID NO: 3187 - protein, 15 aa, synthetic construct
  REGION 1..15: note = Synthetic
TQAWTNFKKWFKKMV

SEQ ID NO: 3188 - protein, 17 aa, synthetic construct
  REGION 1..17: note = Synthetic
KDLHTVVSAILQALGKK

SEQ ID NO: 3189 - protein, 41 aa, synthetic construct
  REGION 1..41: note = Synthetic
EFMQRALQDLRKTAYSLDARTESLLLQAERRALCACWPAGH

SEQ ID NO: 3190 - protein, 42 aa, synthetic construct
  REGION 1..42: note = Synthetic
CNRACGTCCARCNCVPPGTSGNTETCPCYASLTTHGNKRKCP

SEQ ID NO: 3191 - protein, 25 aa, synthetic construct
  REGION 1..25: note = Synthetic
GAVGILNSFLDEYLDIDIAKKLRHF

SEQ ID NO: 3192 - protein, 16 aa, synthetic construct
  REGION 1..16: note = Synthetic
KYLKSLFSHASEVVKP

SEQ ID NO: 3193 - protein, 23 aa, synthetic construct
  REGION 1..23: note = Synthetic
CNEGWEKCASYYSPIAECCRKKK

SEQ ID NO: 3194 - protein, 23 aa, synthetic construct
  REGION 1..23: note = Synthetic
CNEGWEKCASYYSPIAECCRKKK

SEQ ID NO: 3195 - protein, 25 aa, synthetic construct
  REGION 1..25: note = Synthetic
KGCSRCCSYAGEAVDHEVAAAKPNN

SEQ ID NO: 3196 - protein, 17 aa, synthetic construct
  REGION 1..17: note = Synthetic
GGNCDGVMRQCKCIRQC

SEQ ID NO: 3197 - protein, 12 aa, synthetic construct
  REGION 1..12: note = Synthetic
CGWVEAAYKGLV

SEQ ID NO: 3198 - protein, 20 aa, synthetic construct
  REGION 1..20: note = Synthetic
IMYLVRKIIKYCRKLKSCYE

SEQ ID NO: 3199 - protein, 20 aa, synthetic construct
  REGION 1..20: note = Synthetic
IMYLVRKIIKYCRKLKSCYE

SEQ ID NO: 3200 - protein, 24 aa, synthetic construct
  REGION 1..24: note = Synthetic
YKCGARIGRNCFCLQKGVIYKRED

SEQ ID NO: 3201 - protein, 36 aa, synthetic construct
  REGION 1..36: note = Synthetic
RDCAGYMRECKEKLCCSGYVCSSRWKWCVLPAPWRR

SEQ ID NO: 3202 - protein, 36 aa, synthetic construct; identical to SEQ ID NO: 3201
  REGION 1..36: note = Synthetic

SEQ ID NO: 3203 - protein, 36 aa, synthetic construct; identical to SEQ ID NO: 3201
  REGION 1..36: note = Synthetic

SEQ ID NO: 3204 - protein, 36 aa, synthetic construct; identical to SEQ ID NO: 3201
  REGION 1..36: note = Synthetic

SEQ ID NO: 3205 - protein, 36 aa, synthetic construct; identical to SEQ ID NO: 3201
  REGION 1..36: note = Synthetic

SEQ ID NO: 3206 - protein, 36 aa, synthetic construct; identical to SEQ ID NO: 3201
  REGION 1..36: note = Synthetic

SEQ ID NO: 3207 - protein, 36 aa, synthetic construct; identical to SEQ ID NO: 3201
  REGION 1..36: note = Synthetic

SEQ ID NO: 3208 - protein, 36 aa, synthetic construct; identical to SEQ ID NO: 3201
  REGION 1..36: note = Synthetic

SEQ ID NO: 3209 - protein, 36 aa, synthetic construct; identical to SEQ ID NO: 3201
  REGION 1..36: note = Synthetic

SEQ ID NO: 3210 - protein, 36 aa, synthetic construct; identical to SEQ ID NO: 3201
  REGION 1..36: note = Synthetic

SEQ ID NO: 3211 - protein, 36 aa, synthetic construct; identical to SEQ ID NO: 3201
  REGION 1..36: note = Synthetic

SEQ ID NO: 3212 - protein, 36 aa, synthetic construct; identical to SEQ ID NO: 3201
  REGION 1..36: note = Synthetic

SEQ ID NO: 3213 - protein, 36 aa, synthetic construct; identical to SEQ ID NO: 3201
  REGION 1..36: note = Synthetic

SEQ ID NO: 3214 - protein, 36 aa, synthetic construct; identical to SEQ ID NO: 3201
  REGION 1..36: note = Synthetic

SEQ ID NO: 3215 - protein, 36 aa, synthetic construct; identical to SEQ ID NO: 3201
  REGION 1..36: note = Synthetic

SEQ ID NO: 3216 - protein, 36 aa, synthetic construct; identical to SEQ ID NO: 3201
  REGION 1..36: note = Synthetic

SEQ ID NO: 3217 - protein, 36 aa, synthetic construct; identical to SEQ ID NO: 3201
  REGION 1..36: note = Synthetic

SEQ ID NO: 3218 - protein, 36 aa, synthetic construct
  REGION 1..36: note = Synthetic
RDCAGYMRECKEKLCCSGYVCSSRWKWCVLSAPWRR

SEQ ID NO: 3219 - protein, 36 aa, synthetic construct
  REGION 1..36: note = Synthetic
RDCAGYMRECKEKLCCSGYVCPSRWKWCVLPAPWRR

SEQ ID NO: 3220 - protein, 36 aa, synthetic construct
  REGION 1..36: note = Synthetic
RDCAGYMRECKEKLCCSGYVCSSRWKWCVSPAPWRR

SEQ ID NO: 3221 - protein, 21 aa, synthetic construct
  REGION 1..21: note = Synthetic
TVVEFLNKWITFCQSIYSTLT

SEQ ID NO: 3222 - protein, 21 aa, synthetic construct
  REGION 1..21: note = Synthetic
TVVEFLNKWITFCQSIYSTMT

SEQ ID NO: 3223 - protein, 34 aa, synthetic construct
  REGION 1..34: note = Synthetic
INNFAACGKAWPEDKKRKVNKCYICDNELTLCTR

SEQ ID NO: 3224 - protein, 13 aa, synthetic construct
  REGION 1..13: note = Synthetic
VTAAIRKVGTGAA

SEQ ID NO: 3225 - protein, 12 aa, synthetic construct
  REGION 1..12: note = Synthetic
KALREYCSVVRN

SEQ ID NO: 3226 - protein, 20 aa, synthetic construct
  REGION 1..20: note = Synthetic
AVEFLNKWITFCQSIYSTMT

SEQ ID NO: 3227 - protein, 11 aa, synthetic construct
  REGION 1..11: note = Synthetic
ISAISAIAHHL

SEQ ID NO: 3228 - protein, 38 aa, synthetic construct
  REGION 1..38: note = Synthetic
IYGGCGGNANNFSSYYECHIKCFGPRAIIFPEDSPKEN

SEQ ID NO: 3229 - protein, 33 aa, synthetic construct
  REGION 1..33: note = Synthetic
SKILRSLQAFLAIAARVFAHGAATLTEPLVPTA

SEQ ID NO: 3230 - protein, 37 aa, synthetic construct
  REGION 1..37: note = Synthetic
RCLSPMNHLCHKDADCSGKKRCCPSACGRDCRDPARG

SEQ ID NO: 3231 - protein, 35 aa, synthetic construct
  REGION 1..35: note = Synthetic
VKRFKKFFKKLKNNVKKRVKKFFRKPRVIGVTIPF

SEQ ID NO: 3232 - protein, 42 aa, synthetic construct
  REGION 1..42: note = Synthetic
CYGAAGTCGRIVCDCDRTAALCFGDSEYIERHKNIDTKRHCQ

SEQ ID NO: 3233 - protein, 24 aa, synthetic construct
  REGION 1..24: note = Synthetic
YKSGARIGRNCFCLQKGVIYKREN

SEQ ID NO: 3234 - protein, 14 aa, synthetic construct
  REGION 1..14: note = Synthetic
LLHHGLNCAKGVLA

SEQ ID NO: 3235 - protein, 21 aa, synthetic construct
  REGION 1..21: note = Synthetic
GRKCCSTWDKCHPVHLPCPSS

SEQ ID NO: 3236 - protein, 37 aa, synthetic construct; identical to SEQ ID NO: 3169
  REGION 1..37: note = Synthetic

SEQ ID NO: 3237 - protein, 37 aa, synthetic construct; identical to SEQ ID NO: 3169
  REGION 1..37: note = Synthetic

SEQ ID NO: 3238 - protein, 21 aa, synthetic construct
  REGION 1..21: note = Synthetic
TVVEFLNKWITFCQSIYSTLT

SEQ ID NO: 3239 - protein, 19 aa, synthetic construct
  REGION 1..19: note = Synthetic
EAIKSLLKAVSQRRSKRAP

SEQ ID NO: 3240 - protein, 42 aa, synthetic construct
  REGION 1..42: note = Synthetic
CYGAAGTCGRIVCDCDRTAALCFGDSEYIGAHKNIDTKRHCQ

SEQ ID NO: 3241 - protein, 20 aa, synthetic construct
  REGION 1..20: note = Synthetic
LAEQLMEKIKNLWYKRALGY

SEQ ID NO: 3242 - protein, 42 aa, synthetic construct
  REGION 1..42: note = Synthetic
CYGAAGTCARIVCDCDRTAALCFGDSEYIEGHKRIDTKRYCQ

SEQ ID NO: 3243 - protein, 22 aa, synthetic construct
  REGION 1..22: note = Synthetic
AFNAIAKGVAAMKKAKCKHKSG

SEQ ID NO: 3244 - protein, 22 aa, synthetic construct
  REGION 1..22: note = Synthetic
AFNAIAKGVAAMKKAKCKHKSG

SEQ ID NO: 3245 - protein, 21 aa, synthetic construct
  REGION 1..21: note = Synthetic
KNINEFLKSFIHIVQMFINPS

SEQ ID NO: 3246 - protein, 30 aa, synthetic construct
  REGION 1..30: note = Synthetic
LDSFTSVINSAYTFFAVIQTKYSQSSSHNL

SEQ ID NO: 3247 - protein, 13 aa, synthetic construct
  REGION 1..13: note = Synthetic
ERYANYGETLGNN

SEQ ID NO: 3248 - protein, 22 aa, synthetic construct
  REGION 1..22: note = Synthetic
WYSFLEELHSAFQQIAGEAESK

SEQ ID NO: 3249 - protein, 36 aa, synthetic construct
  REGION 1..36: note = Synthetic
RDCAGYMRECNEKLCCSGYVCSSRWKWCVLPAPWRR

SEQ ID NO: 3250 - protein, 24 aa, synthetic construct
  REGION 1..24: note = Synthetic
YKSGARIGRNCFCLQKGVIYKRED

SEQ ID NO: 3251 - protein, 27 aa, synthetic construct
  REGION 1..27: note = Synthetic
GSCASVCRKAIGVAAGKCINGRCVCYP

SEQ ID NO: 3252 - protein, 21 aa, synthetic construct
  REGION 1..21: note = Synthetic
SSWPHLLREILRAARLEGPAG

SEQ ID NO: 3253 - protein, 24 aa, synthetic construct
  REGION 1..24: note = Synthetic
YKSGTRIGRNCFCLQKGVIYKREN

SEQ ID NO: 3254 - protein, 24 aa, synthetic construct
  REGION 1..24: note = Synthetic
YKSGTRIGRNCFCLQKGVIYKREN

SEQ ID NO: 3255 - protein, 24 aa, synthetic construct
  REGION 1..24: note = Synthetic
YKSGTRIGRNCFCLQKGVIYKREN

SEQ ID NO: 3256 - protein, 24 aa, synthetic construct
  REGION 1..24: note = Synthetic
ILDAMGKAWNAVGNSISRYYCSAE

SEQ ID NO: 3257 - protein, 26 aa, synthetic construct
  REGION 1..26: note = Synthetic
FAYCNAGWEKCLAVYTPVASCCRKKK

SEQ ID NO: 3258 - protein, 22 aa, synthetic construct
  REGION 1..22: note = Synthetic
RGLLSGILGAGKHIVCGLSGLC

SEQ ID NO: 3259 - protein, 22 aa, synthetic construct
  REGION 1..22: note = Synthetic
RGLLSGILGAGKHIVCGLSGLC

SEQ ID NO: 3260 - protein, 34 aa, synthetic construct
  REGION 1..34: note = Synthetic
KQCEEIANKVIKPIKEALEQGVTSEDVCKKILAC

SEQ ID NO: 3261 - protein, 40 aa, synthetic construct
  REGION 1..40: note = Synthetic
WMNLLTTGIAAVSILLYLSATIILPNVLRLLVARAIIVRV

SEQ ID NO: 3262 - protein, 36 aa, synthetic construct
  REGION 1..36: note = Synthetic
SKALNAAKNFVSEKIGATPSEAGQIPFDEFMDVLYS

SEQ ID NO: 3263 - protein, 24 aa, synthetic construct
  REGION 1..24: note = Synthetic
DDYTKCCNSFDAFLMCGFLLSKES

SEQ ID NO: 3264 - protein, 21 aa, synthetic construct
  REGION 1..21: note = Synthetic
NAVEFLNKWITFCQSIYSTMT

SEQ ID NO: 3265 - protein, 21 aa, synthetic construct
  REGION 1..21: note = Synthetic
NAVEFLNKWITFCQSIYSTMT

SEQ ID NO: 3266 - protein, 21 aa, synthetic construct
  REGION 1..21: note = Synthetic
NAVEFLNKWITFCQSIYSTMT

SEQ ID NO: 3267 - protein, 21 aa, synthetic construct
  REGION 1..21: note = Synthetic
NAVEFLNKWITFCQSIYSTMT

SEQ ID NO: 3268 - protein, 21 aa, synthetic construct
  REGION 1..21: note = Synthetic
NAVEFLNKWITFCQSIYSTMT

SEQ ID NO: 3269 - protein, 21 aa, synthetic construct
  REGION 1..21: note = Synthetic
NAVEFLNKWITFCQSIYSTMT

SEQ ID NO: 3270 - protein, 21 aa, synthetic construct
  REGION 1..21: note = Synthetic
NAVEFLNKWITFCQSIYSTMT

SEQ ID NO: 3271 - protein, 21 aa, synthetic construct
  REGION 1..21: note = Synthetic
NAVEFLNKWITFCQSIYSTMT

SEQ ID NO: 3272 - protein, 18 aa, synthetic construct
  REGION 1..18: note = Synthetic
WTQFMQVCERLAKNANPV

SEQ ID NO: 3273 - protein, 34 aa, synthetic construct
  REGION 1..34: note = Synthetic
ELGHKIMKNLENTVKEIIKYLKSLFPPASEVVKP

SEQ ID NO: 3274 - protein, 20 aa, synthetic construct
  REGION 1..20: note = Synthetic
MTKYLTALRHYINLVTRQRY

SEQ ID NO: 3275 - protein, 28 aa, synthetic construct
  REGION 1..28: note = Synthetic
VCKDLINIMEGLERQVRQCACGEQVWLF

SEQ ID NO: 3276 - protein, 37 aa, synthetic construct
  REGION 1..37: note = Synthetic
ITKASKCAKKIYKRHKFQAWYGWRNHCQGTLPDISKC

SEQ ID NO: 3277 - protein, 16 aa, synthetic construct
  REGION 1..16: note = Synthetic
IRNIFSQILHAATSLS

SEQ ID NO: 3278 - protein, 14 aa, synthetic construct
  REGION 1..14: note = Synthetic
LNSCGKNVPQGFVC

SEQ ID NO: 3279 - protein, 27 aa, synthetic construct
  REGION 1..27: note = Synthetic
IQRIIDTFGTIINEISNIIRKIIPDLQ

SEQ ID NO: 3280 - protein, 24 aa, synthetic construct
  REGION 1..24: note = Synthetic
YKSGARIGRNCFCLQKGVIYKREN

SEQ ID NO: 3281 - protein, 24 aa, synthetic construct
  REGION 1..24: note = Synthetic
YKSGARIGRNCFCLQKGVIYKREN

SEQ ID NO: 3282 - protein, 24 aa, synthetic construct
  REGION 1..24: note = Synthetic
YKSGARIGRNCFCLQKGVIYKREN

SEQ ID NO: 3283 - protein, 24 aa, synthetic construct
  REGION 1..24: note = Synthetic
YKSGARIGRNCFCLQKGVIYKREN

SEQ ID NO: 3284 - protein, 42 aa, synthetic construct
  REGION 1..42: note = Synthetic
KWVQDYIAKLDQRTQQKQNSTAPQTSKPLNIRFTTQDPKNRS

SEQ ID NO: 3285 - protein, 42 aa, synthetic construct; identical to SEQ ID NO: 3105
  REGION 1..42: note = Synthetic

SEQ ID NO: 3286 - protein, 42 aa, synthetic construct; identical to SEQ ID NO: 3105
  REGION 1..42: note = Synthetic

SEQ ID NO: 3287 - protein, 36 aa, synthetic construct
  REGION 1..36: note = Synthetic
GAFCGQACSSVKCPKKCFCHPEEKVCYREMRTKERD

SEQ ID NO: 3288 - protein, 24 aa, synthetic construct
  REGION 1..24: note = Synthetic
WLAGCPSGWHNCKKHKPTIGWCCK

SEQ ID NO: 3289 - protein, 11 aa, synthetic construct
  REGION 1..11: note = Synthetic
LRELEELLEDY

SEQ ID NO: 3290 - protein, 15 aa, synthetic construct
  REGION 1..15: note = Synthetic
YHTCCQNGLKCVRYP

SEQ ID NO: 3291 - protein, 21 aa, synthetic construct
  REGION 1..21: note = Synthetic
NRFGSRIDGIYNGLCRDSIWK

SEQ ID NO: 3292 - protein, 23 aa, synthetic construct
  REGION 1..23: note = Synthetic
GQTLGKFLQDILWEEAEETLADE

SEQ ID NO: 3293 - protein, 23 aa, synthetic construct
  REGION 1..23: note = Synthetic
GQTLGKFLQDILWEEAEETLANE

SEQ ID NO: 3294 - protein, 13 aa, synthetic construct
  REGION 1..13: note = Synthetic
QYSRLGDKWARNK

SEQ ID NO: 3295 - protein, 34 aa, synthetic construct
  REGION 1..34: note = Synthetic
STIISNITDIVRELDVHIFTRETSTVANGGPVPI

SEQ ID NO: 3296 - protein, 31 aa, synthetic construct
  REGION 1..31: note = Synthetic
DILDKMENAIHKAAQAGIGLAKPIENMILPK

SEQ ID NO: 3297 - protein, 31 aa, synthetic construct
  REGION 1..31: note = Synthetic
DFVDKLKKFAHTDNAEPDQLRREKAPNNDNY

SEQ ID NO: 3298 - protein, 42 aa, synthetic construct
  REGION 1..42: note = Synthetic
IQGAARALGSGLNAGRAAGIPKACGVNIPYKISTSTNCKTVR

SEQ ID NO: 3299 - protein, 11 aa, synthetic construct
  REGION 1..11: note = Synthetic
ISAISAIADHL

SEQ ID NO: 3300 - protein, 30 aa, synthetic construct
  REGION 1..30: note = Synthetic
MQQMQQMMQYLPRMCGMSYPTECRMRPIFA

SEQ ID NO: 3301 - protein, 27 aa, synthetic construct
  REGION 1..27: note = Synthetic
VEHLVEGLRKCVNELGPEASEAVKKLL

SEQ ID NO: 3302 - protein, 18 aa, synthetic construct
  REGION 1..18: note = Synthetic
FQRFLETAYRALRHLTSL

SEQ ID NO: 3303 - protein, 26 aa, synthetic construct
  REGION 1..26: note = Synthetic
VLSHADEIARDLEEWIRHRYHESWLV

SEQ ID NO: 3304 - protein, 33 aa, synthetic construct
  REGION 1..33: note = Synthetic
LIRGLDTALRRMGDCQSRDATDGFPTIRVHLGV

SEQ ID NO: 3305 - protein, 29 aa, synthetic construct
  REGION 1..29: note = Synthetic
FHDCEDAARELQSQIVEARADLARRGLRF

SEQ ID NO: 3306 - protein, 19 aa, synthetic construct
  REGION 1..19: note = Synthetic
EFLSRWITFCQSIIATMTQ

SEQ ID NO: 3307 - protein, 17 aa, synthetic construct
  REGION 1..17: note = Synthetic
CKAFSKGGNACWCKGLR

SEQ ID NO: 3308 - protein, 16 aa, synthetic construct
  REGION 1..16: note = Synthetic
YRRGCSAATGCYRFTN

SEQ ID NO: 3309 - protein, 17 aa, synthetic construct
  REGION 1..17: note = Synthetic
LKNLMERFMQHVSHCQN

SEQ ID NO: 3310 - protein, 42 aa, synthetic construct
  REGION 1..42: note = Synthetic
IADAVACAKRVVSDPQGVRAWVAWRNHCQNKDVSQYVKGCGV

SEQ ID NO: 3311 - protein, 15 aa, synthetic construct
  REGION 1..15: note = Synthetic
RIVDAVREIIDDFCD

SEQ ID NO: 3312 - protein, 16 aa, synthetic construct
  REGION 1..16: note = Synthetic
NVAKKLVSHVAKKQLE

SEQ ID NO: 3313 - protein, 20 aa, synthetic construct
  REGION 1..20: note = Synthetic
VLDILKNAAKNILAHAAEQI

SEQ ID NO: 3314 - protein, 16 aa, synthetic construct
  REGION 1..16: note = Synthetic
DAKQWIKTMFKNWYQT

SEQ ID NO: 3315 - protein, 16 aa, synthetic construct
  REGION 1..16: note = Synthetic
GTNIWNEIRTWSNWKA

SEQ ID NO: 3316 - protein, 24 aa, synthetic construct
  REGION 1..24: note = Synthetic
ARTCIYTLLTNCTTCLNDNGIVCP

SEQ ID NO: 3317 - protein, 24 aa, synthetic construct
  REGION 1..24: note = Synthetic
MYGGCGGNANNFKTIVECHRTCVG

SEQ ID NO: 3318 - protein, 15 aa, synthetic construct
  REGION 1..15: note = Synthetic
VETILKNWLSIIQKK

SEQ ID NO: 3319 - protein, 26 aa, synthetic construct
  REGION 1..26: note = Synthetic
TTVRSVAQSAGYWLDPPEFDKAHGKK

SEQ ID NO: 3320 - protein, 29 aa, synthetic construct
  REGION 1..29: note = Synthetic
ETFCTNLINLLYRLFCLRASDERATENTY

SEQ ID NO: 3321 - protein, 27 aa, synthetic construct
  REGION 1..27: note = Synthetic
DAENAWNKAFEEMYKIVFANLSGNPVS

SEQ ID NO: 3322 - protein, 25 aa, synthetic construct
  REGION 1..25: note = Synthetic
SDIIDELKDAVKTVKETWSEVKQIG

SEQ ID NO: 3323 - protein, 17 aa, synthetic construct
  REGION 1..17: note = Synthetic
GGNCDGVIRQCKCIRQC

SEQ ID NO: 3324 - protein, 20 aa, synthetic construct
  REGION 1..20: note = Synthetic
ITEFLNKWITFCQSIFSTLT

SEQ ID NO: 3325 - protein, 20 aa, synthetic construct
  REGION 1..20: note = Synthetic
ITEFLNKWITFCQSIFSTLT

SEQ ID NO: 3326 - protein, 20 aa, synthetic construct
  REGION 1..20: note = Synthetic
ITEFLNKWITFCQSIFSTLT

SEQ ID NO: 3327 - protein, 20 aa, synthetic construct
  REGION 1..20: note = Synthetic
ITEFLNKWITFCQSIFSTLT

SEQ ID NO: 3328 - protein, 20 aa, synthetic construct
  REGION 1..20: note = Synthetic
ITEFLNKWITFCQSIFSTLT

SEQ ID NO: 3329 - protein, 20 aa, synthetic construct
  REGION 1..20: note = Synthetic
ITEFLNKWITFCQSIFSTLT

SEQ ID NO: 3330 - protein, 28 aa, synthetic construct
  REGION 1..28: note = Synthetic
DNVQTAFNKAFDTMYYVIFENLDGHTVN

SEQ ID NO: 3331 - protein, 25 aa, synthetic construct
  REGION 1..25: note = Synthetic
ERGFGCFRSCWKAGHDDKTCKSMCG

SEQ ID NO: 3332 - protein, 27 aa, synthetic construct
  REGION 1..27: note = Synthetic
KDLISVIEDLLTFFRAQMRKLVMNPKH

SEQ ID NO: 3333 - protein, 41 aa, synthetic construct
  REGION 1..41: note = Synthetic
GYYGDLAARLGYFPSSIVREDLTLKPGKIDMKTDQWDFYCQ

SEQ ID NO: 3334 - protein, 23 aa, synthetic construct
  REGION 1..23: note = Synthetic
LEDIWNSLSSVFTETQPVERIQR

SEQ ID NO: 3335 - protein, 18 aa, synthetic construct
  REGION 1..18: note = Synthetic
MKCCRNGCGKMGCTTPKF

SEQ ID NO: 3336 - protein, 25 aa, synthetic construct
  REGION 1..25: note = Synthetic
NALTFLKSLLEIFQKEKMRGMRGKI

SEQ ID NO: 3337 - protein, 25 aa, synthetic construct
  REGION 1..25: note = Synthetic
NALTFLKSLLEIFQKEKMRGMRGKI

SEQ ID NO: 3338 - protein, 25 aa, synthetic construct
  REGION 1..25: note = Synthetic
NALTFLKSLLEIFQKEKMRGMRGKI

SEQ ID NO: 3339 - protein, 25 aa, synthetic construct
  REGION 1..25: note = Synthetic
NALTFLKSLLEIFQKEKMRGMRGKI

SEQ ID NO: 3340 - protein, 31 aa, synthetic construct
  REGION 1..31: note = Synthetic
FQQVVDTLQSMVTNGPDTAQKDVDSINNNRC

SEQ ID NO: 3341 - protein, 22 aa, synthetic construct
  REGION 1..22: note = Synthetic
ALSRLQGALQDMLRQLDLSPGC

SEQ ID NO: 3342 - protein, 42 aa, synthetic construct
  REGION 1..42: note = Synthetic
SNIGEHAKSLYTDTVAVLTPYLQKIRENVTKMYQVYVESKQH

SEQ ID NO: 3343 - protein, 36 aa, synthetic construct
  REGION 1..36: note = Synthetic
RDCAGYMRECKEKLCCSGYVCSSGWKWCVLPAPWRR

SEQ ID NO: 3344 - protein, 26 aa, synthetic construct
  REGION 1..26: note = Synthetic
NAMIGVAKSVGKTALSTLACKIDKSC

SEQ ID NO: 3345 - protein, 11 aa, synthetic construct
  REGION 1..11: note = Synthetic
YGSYSGLGSSL

SEQ ID NO: 3346 - protein, 26 aa, synthetic construct
  REGION 1..26: note = Synthetic
EDIFDVVKTVVEVAEAMRDEKKKKEL

SEQ ID NO: 3347 - protein, 18 aa, synthetic construct
  REGION 1..18: note = Synthetic
AKKAVGKCDDFKCNCIKL

SEQ ID NO: 3348 - protein, 34 aa, synthetic construct
  REGION 1..34: note = Synthetic
MCQYLESWWRTMRSCRDSSGLSGPCPGTYGTCWT

SEQ ID NO: 3349 - protein, 30 aa, synthetic construct
  REGION 1..30: note = Synthetic
ARRWRRAFRRLRKIAPLIPTFVRLYPVGKK

SEQ ID NO: 3350 - protein, 16 aa, synthetic construct
  REGION 1..16: note = Synthetic
KVLKAVGKQAAKKQME

SEQ ID NO: 3351 - protein, 18 aa, synthetic construct
  REGION 1..18: note = Synthetic
LQSFLELAYRVLRYLAQP

SEQ ID NO: 3352 - protein, 13 aa, synthetic construct
  REGION 1..13: note = Synthetic
GKDLSKYLEGCHL

SEQ ID NO: 3353 - protein, 24 aa, synthetic construct
  REGION 1..24: note = Synthetic
YKNGARIGRNCFCLQKGVLYKKEN

SEQ ID NO: 3354 - protein, 25 aa, synthetic construct
  REGION 1..25: note = Synthetic
GLLSVLGSVAKHVLPHVVPVIAEKL

SEQ ID NO: 3355 - protein, 25 aa, synthetic construct
  REGION 1..25: note = Synthetic
GLLSVLGSVAKHVLPHVVPVIAEKL

SEQ ID NO: 3356 - protein, 22 aa, synthetic construct
  REGION 1..22: note = Synthetic
TVVDFLRRWIAFCQSIISTSPQ

SEQ ID NO: 3357 - protein, 29 aa, synthetic construct
  REGION 1..29: note = Synthetic
WRCIREALDEVARAVGIELASKPAAAASD

SEQ ID NO: 3358 - protein, 26 aa, synthetic construct
  REGION 1..26: note = Synthetic
RVQDALSGYCRNENPCCVRRVLMEDG

SEQ ID NO: 3359 - protein, 42 aa, synthetic construct
  REGION 1..42: note = Synthetic
GSFGNIFGHFLGRVGTRYISSLFNKKREERKSNHAYIIEDYN

SEQ ID NO: 3360 - protein, 22 aa, synthetic construct
  REGION 1..22: note = Synthetic
LFGVLAKVASHVVPAIAEHFQA

SEQ ID NO: 3361 - protein, 33 aa, synthetic construct
  REGION 1..33: note = Synthetic
RGVTTFWETVETLVSNGFISDRGHKWLMGHEKA

SEQ ID NO: 3362 - protein, 25 aa, synthetic construct
  REGION 1..25: note = Synthetic
EWAKVWTKLFYILYSCNHHNCANDI

SEQ ID NO: 3363 - protein, 32 aa, synthetic construct
  REGION 1..32: note = Synthetic
QRCNRWCHNGCGNGKGDYCKAMSHGGLCHCYC

SEQ ID NO: 3364 - protein, 12 aa, synthetic construct
  REGION 1..12: note = Synthetic
CGWVSRAWKGVV

SEQ ID NO: 3365 - protein, 24 aa, synthetic construct
  REGION 1..24: note = Synthetic
ESMKTLVQDMYYLIQYWRQADDTR

SEQ ID NO: 3366 - protein, 17 aa, synthetic construct
  REGION 1..17: note = Synthetic
FEEFADSACRIIEKIYA

SEQ ID NO: 3367 - protein, 34 aa, synthetic construct
  REGION 1..34: note = Synthetic
LANFIASLTAGALVLSAIGIALIIISKNDRVQRS

SEQ ID NO: 3368 - protein, 24 aa, synthetic construct
  REGION 1..24: note = Synthetic
IKEAMESLPKAVRDELEKAIAGGA

SEQ ID NO: 3369 - protein, 24 aa, synthetic construct
  REGION 1..24: note = Synthetic
IKEAMESLPKAVRDELEKAIAGGA

SEQ ID NO: 3370 - protein, 24 aa, synthetic construct
  REGION 1..24: note = Synthetic
IKEAMESLPKAVRDELEKAIAGGA

SEQ ID NO: 3371 - protein, 23 aa, synthetic construct
  REGION 1..23: note = Synthetic
ACYSASTCCSKACNLTTKRCVLS

SEQ ID NO: 3372 - protein, 40 aa, synthetic construct
  REGION 1..40: note = Synthetic
ACELYQGLCRNACQKYEIQYLSCPKTRKCCLKYPRKITSF

SEQ ID NO: 3373 - protein, 19 aa, synthetic construct
  REGION 1..19: note = Synthetic
MMDEFDQYARKVQMVGRKK

SEQ ID NO: 3374 - protein, 24 aa, synthetic construct
  REGION 1..24: note = Synthetic
FMGGLIKAATKIVPAAYCAITKKC

SEQ ID NO: 3375 - protein, 36 aa, synthetic construct
  REGION 1..36: note = Synthetic
RDCAGYMRECKEKLCCSGYVCSSRWKWCVLPAPWCR

SEQ ID NO: 3376 - protein, 36 aa, synthetic construct
  REGION 1..36: note = Synthetic
RDCAGYMRECKEKLCCSGYVCSSRWKWCVLPAPWRC

SEQ ID NO: 3377 - protein, 17 aa, synthetic construct
  REGION 1..17: note = Synthetic
CGGRGRKCFGQCLCGYD

SEQ ID NO: 3378 - protein, 24 aa, synthetic construct
  REGION 1..24: note = Synthetic
YKSGARIGRNCFCLQKGVIYKRED

SEQ ID NO: 3379 - protein, 33 aa, synthetic construct
  REGION 1..33: note = Synthetic
KCCAGGCRSGKCINGKCQCYGRSDLNEEFENYQ

SEQ ID NO: 3380 - protein, 29 aa, synthetic construct
  REGION 1..29: note = Synthetic
KVFQAVRYFIHMLENGYRLWLSSIGTGMG

SEQ ID NO: 3381 - protein, 27 aa, synthetic construct
  REGION 1..27: note = Synthetic
SARKLLQDIMSRQQGERNQEQGARVRL

SEQ ID NO: 3382 - protein, 21 aa, synthetic construct
  REGION 1..21: note = Synthetic
KNINEFLKSFIHIVQMFINPS

SEQ ID NO: 3383 - protein, 21 aa, synthetic construct
  REGION 1..21: note = Synthetic
KNINEFLKSFIHIVQMFINPS

SEQ ID NO: 3384 - protein, 20 aa, synthetic construct
  REGION 1..20: note = Synthetic
MAQYAAEMRRYINMLTRPRY

SEQ ID NO: 3385 - protein, 33 aa, synthetic construct; identical to SEQ ID NO: 3229
  REGION 1..33: note = Synthetic

SEQ ID NO: 3386 - protein, 31 aa, synthetic construct
  REGION 1..31: note = Synthetic
MEEFKNFIKRMNLRLENMFVPEIGDKCVESD

SEQ ID NO: 3387 - protein, 24 aa, synthetic construct
  REGION 1..24: note = Synthetic
GKTFAKEGGKFGLEFIACKVTNQC

SEQ ID NO: 3388 - protein, 12 aa, synthetic construct
  REGION 1..12: note = Synthetic
YGEGFRWISQYI

SEQ ID NO: 3389 - protein, 42 aa, synthetic construct
  REGION 1..42: note = Synthetic
CTDAAGTCARIVCDCDRTAAICFAAAPYNINNFMISSSTHCQ

SEQ ID NO: 3390 - protein, 22 aa, synthetic construct
  REGION 1..22: note = Synthetic
QKCAECCGGIGKCYGPQCLCNR

SEQ ID NO: 3391 - protein, 12 aa, synthetic construct
  REGION 1..12: note = Synthetic
FQEAYRRFYGPV

SEQ ID NO: 3392 - protein, 17 aa, synthetic construct
  REGION 1..17: note = Synthetic
VDNIRSILDYISRLLGE

SEQ ID NO: 3393 - protein, 17 aa, synthetic construct
  REGION 1..17: note = Synthetic
VDNIRSILDYISRLLGE

SEQ ID NO: 3394 - protein, 18 aa, synthetic construct
  REGION 1..18: note = Synthetic
CSRCCSYAGKAVQTQSGH

SEQ ID NO: 3395 - protein, 23 aa, synthetic construct
  REGION 1..23: note = Synthetic
KEVQKLAKEVLEIFQYCAYRKNQ

SEQ ID NO: 3396 - protein, 16 aa, synthetic construct
  REGION 1..16: note = Synthetic
KYLKSLFSHAFEVVKT

SEQ ID NO: 3397 - protein, 18 aa, synthetic construct
  REGION 1..18: note = Synthetic
SAGKSALNALACKIDKSC

SEQ ID NO: 3398 - protein, 16 aa, synthetic construct
  REGION 1..16: note = Synthetic
KVAKKLVSHVAQKQME

SEQ ID NO: 3399 - protein, 16 aa, synthetic construct
  REGION 1..16: note = Synthetic
GTNIWNEIRTWSNWKA

SEQ ID NO: 3400 - protein, 15 aa, synthetic construct
  REGION 1..15: note = Synthetic
DCCSNFCHTWAIMCL

SEQ ID NO: 3401 - protein, 19 aa, synthetic construct
  REGION 1..19: note = Synthetic
CDFCNDVLARAKYFKDHGF

SEQ ID NO: 3402 - protein, 29 aa, synthetic construct
  REGION 1..29: note = Synthetic
KMIKTGAETLVEEAKTLAAALLEEEIMDN

SEQ ID NO: 3403 - protein, 25 aa, synthetic construct
  REGION 1..25: note = Synthetic
WLAGCPSGWHNCKAHGPNIGWCCKK

SEQ ID NO: 3404 - protein, 25 aa, synthetic construct
  REGION 1..25: note = Synthetic
WLAGCPSGWHNCKAHGPNIGWCCKK

SEQ ID NO: 3405 - protein, 24 aa, synthetic construct
  REGION 1..24: note = Synthetic
DNISRVIRQWDTIVQESSGNAPRL

SEQ ID NO: 3406 - protein, 22 aa, synthetic construct
  REGION 1..22: note = Synthetic
TIVEFLNRWITFCQSIISASSS

SEQ ID NO: 3407 - protein, 31 aa, synthetic construct
  REGION 1..31: note = Synthetic
WQVIGQLVSTGLIGLLGPAVIILLALKKGNL

SEQ ID NO: 3408 - protein, 37 aa, synthetic construct
  REGION 1..37: note = Synthetic
VSSGFKTVRNMDGGYIAWVNKRFPVKVEHKELKYDEL

SEQ ID NO: 3409 - protein, 19 aa, synthetic construct
  REGION 1..19: note = Synthetic
EQMREIIQTAITALQSFLP

SEQ ID NO: 3410 - protein, 35 aa, synthetic construct
  REGION 1..35: note = Synthetic
RRLLEAAKEIVSLMHKDYKGMGRRKPPINNHEPSH

SEQ ID NO: 3411 - protein, 36 aa, synthetic construct
  REGION 1..36: note = Synthetic
RDCAGYMRECEEKLCCSGYVCSSRWKWCVLPAPWRR

SEQ ID NO: 3412 - protein, 24 aa, synthetic construct
  REGION 1..24: note = Synthetic
SAWDKAFDDMYKIVFSNLDGNPVH

SEQ ID NO: 3413 - protein, 12 aa, synthetic construct
  REGION 1..12: note = Synthetic
YGEGFRWLSQYI

SEQ ID NO: 3414 - protein, 12 aa, synthetic construct
  REGION 1..12: note = Synthetic
YGEGFRWLSQYI

SEQ ID NO: 3415 - protein, 20 aa, synthetic construct
  REGION 1..20: note = Synthetic
DDLDDYCNGISADCPRNPYY

SEQ ID NO: 3416 - protein, 19 aa, synthetic construct
  REGION 1..19: note = Synthetic
AEQLIEKIKNLWYTKVLGY

SEQ ID NO: 3417 - protein, 39 aa, synthetic construct
  REGION 1..39: note = Synthetic
NEVNECAKAYPNAFIRVIGFDNVRQVQCISFIVHKPEYN

SEQ ID NO: 3418 - protein, 24 aa, synthetic construct
  REGION 1..24: note = Synthetic
FNSASTLASSVLTLVLSFSFALLL

SEQ ID NO: 3419 - protein, 31 aa, synthetic construct
  REGION 1..31: note = Synthetic
ARGLLRGGWNDVDYYYGMDVWGQGTTVTVSS

SEQ ID NO: 3420 - protein, 26 aa, synthetic construct
  REGION 1..26: note = Synthetic
NAMIGVAKSAGKTALNTLACKIDKTC

SEQ ID NO: 3421 - protein, 25 aa, synthetic construct
  REGION 1..25: note = Synthetic
KQFIENGSEFAQKLLKKFSLLKPWA

SEQ ID NO: 3422 - protein, 14 aa, synthetic construct
  REGION 1..14: note = Synthetic
FEELGGSLSRLFTG

SEQ ID NO: 3423 - protein, 25 aa, synthetic construct
  REGION 1..25: note = Synthetic
LATYEKAFKQLFPTRPQCGRDKLQC

SEQ ID NO: 3424 - protein, 19 aa, synthetic construct
  REGION 1..19: note = Synthetic
AWKSCLKGILTKISSRLNA

SEQ ID NO: 3425 - protein, 29 aa, synthetic construct
  REGION 1..29: note = Synthetic
LGKAGGHCEKGVCICRKTSFKDLWDKRFG

SEQ ID NO: 3426 - protein, 29 aa, synthetic construct
  REGION 1..29: note = Synthetic
LGKAGGHCEKGVCICRKTSFKDLWDKRFG

SEQ ID NO: 3427 - protein, 20 aa, synthetic construct
  REGION 1..20: note = Synthetic
RGCSRCCSYAGEAVQTQPGH

SEQ ID NO: 3428 - protein, 20 aa, synthetic construct
  REGION 1..20: note = Synthetic
RGCSRCCSYAGEAVQTQPGH

SEQ ID NO: 3429 - protein, 29 aa, synthetic construct
  REGION 1..29: note = Synthetic
DIIKGCAATCPKVDNNDPIRCCGTDKCND

SEQ ID NO: 3430 - protein, 27 aa, synthetic construct
  REGION 1..27: note = Synthetic
RGLLSVLGSVAKHVLPHVVPVIAEHLG

SEQ ID NO: 3431 - protein, 33 aa, synthetic construct
  REGION 1..33: note = Synthetic
MTEFMNLVEEMGIEEENVQRIMDTDNCPSKIKP

SEQ ID NO: 3432 - protein, 19 aa, synthetic construct
  REGION 1..19: note = Synthetic
LHEMIQQIFNLFSTKDSSA

SEQ ID NO: 3433 - protein, 41 aa, synthetic construct
  REGION 1..41: note = Synthetic
EFMQRALQDLRKTACSLDARTETLLLQAERRALCACWPAGH

SEQ ID NO: 3434 - protein, 20 aa, synthetic construct
  REGION 1..20: note = Synthetic
NQLLELITSILNQLQGFLGR

SEQ ID NO: 3435 - protein, 42 aa, synthetic construct
  REGION 1..42: note = Synthetic
KLCSNGGTECNRHCGQNNTVGICHGQNGKLKCECVEYKRKMF

SEQ ID NO: 3436 - protein, 20 aa, synthetic construct
  REGION 1..20: note = Synthetic
RGCSRCCSYAGEAVQTQPGH

SEQ ID NO: 3437 - protein, 20 aa, synthetic construct
  REGION 1..20: note = Synthetic
RGCSRCCSYAGEAVQTQPGH

SEQ ID NO: 3438 - protein, 15 aa, synthetic construct
  REGION 1..15: note = Synthetic
SDAKKLMRDLKRMLY

SEQ ID NO: 3439 - protein, 42 aa, synthetic construct
  REGION 1..42: note = Synthetic
CYGAAGTCGRIVCDCDRTAALCFGNSEYIEGHKNIDTARFCQ

SEQ ID NO: 3440 - protein, 42 aa, synthetic construct
  REGION 1..42: note = Synthetic
CLKNAARGISGLNAGNAASIPSKCGVSVPYTISTSTDCSRVS

SEQ ID NO: 3441 - protein, 40 aa, synthetic construct
  REGION 1..40: note = Synthetic
QGVRSYLSCWGNRGICLLNRCPGRMRQIGTCLAPRVKCCR

SEQ ID NO: 3442 - protein, 21 aa, synthetic construct
  REGION 1..21: note = Synthetic
CPAGWRKCGAEWPAPCCKAIG

SEQ ID NO: 3443 - protein, 15 aa, synthetic construct
  REGION 1..15: note = Synthetic
VDKIAEKVVEQISKI

SEQ ID NO: 3444 - protein, 41 aa, synthetic construct
  REGION 1..41: note = Synthetic
EFMQRALQDLKKMAYNLDTRTETLLLRAEKRGLCDCFPAMH

SEQ ID NO: 3445 - protein, 36 aa, synthetic construct
  REGION 1..36: note = Synthetic
RDCAGYMRECKEKLCCNGYVCSSRWKWCVLPAPWRR

SEQ ID NO: 3446 - protein, 18 aa, synthetic construct
  REGION 1..18: note = Synthetic
LKCCKAMCGKVCLSPVKA

SEQ ID NO: 3447 - protein, 39 aa, synthetic construct
  REGION 1..39: note = Synthetic
GVMATATSVLAEPHRHQGPIFDTRPSPFNPNQPRPGPIY

SEQ ID NO: 3448 - protein, 22 aa, synthetic construct
  REGION 1..22: note = Synthetic
LRGCASSCPKGYTCCATDLCNW

SEQ ID NO: 3449 - protein, 13 aa, synthetic construct
  REGION 1..13: note = Synthetic
HAINAVSAIAKHS

SEQ ID NO: 3450 - protein, 29 aa, synthetic construct
  REGION 1..29: note = Synthetic
CYSGYNGVGKCFDDPKVAGPSNCGCIYNC

SEQ ID NO: 3451 - protein, 24 aa, synthetic construct
  REGION 1..24: note = Synthetic
CDECCKKAGDRAGTCEYFKCKCNP

SEQ ID NO: 3452 - protein, 16 aa, synthetic construct
  REGION 1..16: note = Synthetic
WSTLMRTVHSVIKRTP

SEQ ID NO: 3453 - protein, 24 aa, synthetic construct
  REGION 1..24: note = Synthetic
WRSAATTLFNSLNQFQHLRMNEVW

SEQ ID NO: 3454 - protein, 23 aa, synthetic construct
  REGION 1..23: note = Synthetic
QHLMRTLLSAAGAPRPAAVPIKP

SEQ ID NO: 3455 - protein, 35 aa, synthetic construct
  REGION 1..35: note = Synthetic
ILAQLWDGLKTAPSPSQETLSSHSPVSRSAGPGVA

SEQ ID NO: 3456 - protein, 25 aa, synthetic construct
  REGION 1..25: note = Synthetic
RKVEQFLDYLEEFLQTVNTEWTVES

SEQ ID NO: 3457 - protein, 16 aa, synthetic construct
  REGION 1..16: note = Synthetic
YKCCEGICGKVCLPPM

SEQ ID NO: 3458 - protein, 39 aa, synthetic construct
  REGION 1..39: note = Synthetic
GDSLHDYCTGVTPDCPRNPNKGESDELEWSAAATGSVLM

SEQ ID NO: 3459 - protein, 18 aa, synthetic construct
  REGION 1..18: note = Synthetic
SAAQSVLKGLSCKLSKDC

SEQ ID NO: 3460 - protein, 18 aa, synthetic construct
  REGION 1..18: note = Synthetic
SAAQSVLKGLSCKLSKDC

SEQ ID NO: 3461 - protein, 21 aa, synthetic construct
  REGION 1..21: note = Synthetic
LRDLRGALESLIEEEARQKKM

SEQ ID NO: 3462 - protein, 37 aa, synthetic construct
  REGION 1..37: note = Synthetic
ITKAAKCAKKIYKRHRFDAWYGWKNHCQGSLPDISSC

SEQ ID NO: 3463 - protein, 28 aa, synthetic construct
  REGION 1..28: note = Synthetic
KKAMQIMDEAVELLRYYATTKEYTNICR

SEQ ID NO: 3464 - protein, 26 aa, synthetic construct
  REGION 1..26: note = Synthetic
ASTCEAGCKQIGKSMKSCQGDTCECA

SEQ ID NO: 3465 - protein, 22 aa, synthetic construct
  REGION 1..22: note = Synthetic
TVVEFLNRWITFCQSSIATMTQ

SEQ ID NO: 3466 - protein, 22 aa, synthetic construct
  REGION 1..22: note = Synthetic
IAKGLNTFVNKVPTFGTFFAGF

SEQ ID NO: 3467 - protein, 42 aa, synthetic construct
  REGION 1..42: note = Synthetic
KAVQQVKDAFSKLQEKGIYKAMSEFDIFINYIEAYMTAKINS

SEQ ID NO: 3468 - protein, 20 aa, synthetic construct
  REGION 1..20: note = Synthetic
LFGVLAKVAAHVVPAIAEHF

SEQ ID NO: 3469 - protein, 31 aa, synthetic construct
  REGION 1..31: note = Synthetic
WQVIGQLIATGAIMLAGPAVIVLLALKKGNL

SEQ ID NO: 3470 - protein, 16 aa, synthetic construct
  REGION 1..16: note = Synthetic
KVAKTVAKQVAKKQME

SEQ ID NO: 3471 - protein, 36 aa, synthetic construct
  REGION 1..36: note = Synthetic
RDCAGYMRECKEELCCSGYVCSSRWKWCVLPAPWRR

SEQ ID NO: 3472 - protein, 16 aa, synthetic construct
  REGION 1..16: note = Synthetic
YGRCYASYYSYKKKTL

SEQ ID NO: 3473 - protein, 20 aa, synthetic construct
  REGION 1..20: note = Synthetic
FCKAIVKSGGKISLKHPGKC

SEQ ID NO: 3474 - protein, 28 aa, synthetic construct
  REGION 1..28: note = Synthetic
GRIAGNCIGTVNPKGATCTYYQRCKRAA

SEQ ID NO: 3475 - protein, 34 aa, synthetic construct
  REGION 1..34: note = Synthetic
RFGRNAWGPWSKEQLSPQAREFWSLAAPQRFGKK

SEQ ID NO: 3476 - protein, 19 aa, synthetic construct
  REGION 1..19: note = Synthetic
AEQLMEKIKNLWYTRILGY

SEQ ID NO: 3477 - protein, 29 aa, synthetic construct
  REGION 1..29: note = Synthetic
IRAAHAILGGLHLTLDWAVRGLLLLKTRL

SEQ ID NO: 3478 - protein, 29 aa, synthetic construct
  REGION 1..29: note = Synthetic
IRAAHAILGGLHLTLDWAVRGLLLLKTRL

SEQ ID NO: 3479 - protein, 33 aa, synthetic construct
  REGION 1..33: note = Synthetic
FEDCLNGFEDVVETCHGVSQGGVMTNGNGEHGG

SEQ ID NO: 3480 - protein, 19 aa, synthetic construct
  REGION 1..19: note = Synthetic
KWVEEAIAYLDMKTSTPKP

SEQ ID NO: 3481 - protein, 36 aa, synthetic construct; identical to SEQ ID NO: 3201
  REGION 1..36: note = Synthetic

SEQ ID NO: 3482 - protein, 24 aa, synthetic construct
  REGION 1..24: note = Synthetic
QVVKRLVRGCWTKSYPPKPCFVRG

SEQ ID NO: 3483 - protein, 19 aa, synthetic construct
  REGION 1..19: note = Synthetic
CDFCNDVLARAKYLKRHGF

SEQ ID NO: 3484 - protein, 11 aa, synthetic construct
  REGION 1..11: note = Synthetic
SALGGLLKKIG

SEQ ID NO: 3485 - protein, 21 aa, synthetic construct
  REGION 1..21: note = Synthetic
GMAALMEELRGLGQGIQGQQY

SEQ ID NO: 3486 - protein, 23 aa, synthetic construct
  REGION 1..23: note = Synthetic
VRNFGNACEKIVHSCKTGETFLD

SEQ ID NO: 3487 - protein, 24 aa, synthetic construct
  REGION 1..24: note = Synthetic
AVEKCVNACSTVCTKGSMNAVEIA

SEQ ID NO: 3488 - protein, 15 aa, synthetic construct
  REGION 1..15: note = Synthetic
KLAQEFVEWLKNGKS

SEQ ID NO: 3489 - protein, 12 aa, synthetic construct
  REGION 1..12: note = Synthetic
EKVQAMVGQYLN

SEQ ID NO: 3490 - protein, 42 aa, synthetic construct
  REGION 1..42: note = Synthetic
CLKNMASSFRNLNMGNAASIPSKCGVSVAFPISTSVDCSKIN

SEQ ID NO: 3491 - protein, 42 aa, synthetic construct; identical to SEQ ID NO: 3490
  REGION 1..42: note = Synthetic

SEQ ID NO: 3492 - protein, 21 aa, synthetic construct
  REGION 1..21: note = Synthetic
SIFRTLASSVGTVLSQISASG

SEQ ID NO: 3493 - protein, 14 aa, synthetic construct
  REGION 1..14: note = Synthetic
FEELGGSLSRLFTG

SEQ ID NO: 3494 - protein, 14 aa, synthetic construct
  REGION 1..14: note = Synthetic
FEELGGSLSRLFTG

SEQ ID NO: 3495 - protein, 15 aa, synthetic construct
  REGION 1..15: note = Synthetic
ARDFLRECMQHLKYA

SEQ ID NO: 3496 - protein, 26 aa, synthetic construct
  REGION 1..26: note = Synthetic
EQFLDYLEEFLRTINIEWNTEWTVES

SEQ ID NO: 3497 - protein, 33 aa, synthetic construct
  REGION 1..33: note = Synthetic
CGSDMSTYANECTLCMKIREGGHNIKIIRNGPC

SEQ ID NO: 3498 - protein, 24 aa, synthetic construct
  REGION 1..24: note = Synthetic
YKSGARIGRNCFCLQKGVIYKRED

SEQ ID NO: 3499 - protein, 15 aa, synthetic construct
  REGION 1..15: note = Synthetic
YGKCMTAFMGKICMR

SEQ ID NO: 3500 - protein, 16 aa, synthetic construct
  REGION 1..16: note = Synthetic
NYYKKLFGSGTTLVVT

SEQ ID NO: 3501 - protein, 24 aa, synthetic construct
  REGION 1..24: note = Synthetic
AVERCNEACYHFCNKEADIVTIVS

SEQ ID NO: 3502 - protein, 17 aa, synthetic construct
  REGION 1..17: note = Synthetic
LDNIRSILDYISKLLGE

SEQ ID NO: 3503 - protein, 17 aa, synthetic construct
  REGION 1..17: note = Synthetic
LDNIRSILDYISKLLGE

SEQ ID NO: 3504 - protein, 24 aa, synthetic construct
  REGION 1..24: note = Synthetic
AVDRCNEACYRFCTNEAEIVTVAS

SEQ ID NO: 3505 - protein, 21 aa, synthetic construct
  REGION 1..21: note = Synthetic
LQNITTFMERLMDLLQKLNST

SEQ ID NO: 3506 - protein, 33 aa, synthetic construct
  REGION 1..33: note = Synthetic
SSLKDYWSTLTGKFSGFWDSTFAVTPTPASEAK

SEQ ID NO: 3507 - protein, 18 aa, synthetic construct
  REGION 1..18: note = Synthetic
GVKKCCEGFCGKDCLYPK

SEQ ID NO: 3508 - protein, 38 aa, synthetic construct
  REGION 1..38: note = Synthetic
MKVVQDIIKKITDAVNPLRMTEGFLGGGGSGGSGALFG

SEQ ID NO: 3509 - protein, 31 aa, synthetic construct
  REGION 1..31: note = Synthetic
QLFKLAKQFCERVNQHPEEPSSPNIATGNGL

SEQ ID NO: 3510 - protein, 25 aa, synthetic construct
  REGION 1..25: note = Synthetic
GLFSVLGAVAKHVLPHVVPVIAEKL

SEQ ID NO: 3511 - protein, 24 aa, synthetic construct
  REGION 1..24: note = Synthetic
GLFSVLGAVAKHVLPHVVPVIAEK

SEQ ID NO: 3512 - protein, 24 aa, synthetic construct
  REGION 1..24: note = Synthetic
GLFSVLGAVAKHVLPHVVPVIAEK

SEQ ID NO: 3513 - protein, 29 aa, synthetic construct
  REGION 1..29: note = Synthetic
EEANYAVDRCNDACHRFCTKEAETVTVVS

SEQ ID NO: 3514 - protein, 18 aa, synthetic construct
  REGION 1..18: note = Synthetic
YVNRMMNYLVSGCTRYPA

SEQ ID NO: 3515 - protein, 36 aa, synthetic construct
  REGION 1..36: note = Synthetic
RDCAGYMRECKGKLCCSGYVCSSRWKWCVLPAPWRR

SEQ ID NO: 3516 - protein, 37 aa, synthetic construct
  REGION 1..37: note = Synthetic
KKAVGGLGKLGKDAVEDLESVGKGAVHDVKDVLDSVL

SEQ ID NO: 3517 - protein, 40 aa, synthetic construct
  REGION 1..40: note = Synthetic
NNIMRTIIEFLSFLHLKEAGALDRLLDLPAAASSEDIERS

SEQ ID NO: 3518 - protein, 22 aa, synthetic construct
  REGION 1..22: note = Synthetic
TVVDFLRRWIAFCQSIISTSPQ

SEQ ID NO: 3519 - protein, 24 aa, synthetic construct
  REGION 1..24: note = Synthetic
IYGGCGGNANKFKTIDECHRTCVG

SEQ ID NO: 3520 - protein, 14 aa, synthetic construct
  REGION 1..14: note = Synthetic
KLLDTLLQNLYDFA

SEQ ID NO: 3521 - protein, 14 aa, synthetic construct
  REGION 1..14: note = Synthetic
WNSCMNQIVSGISG

SEQ ID NO: 3522 - protein, 36 aa, synthetic construct
  REGION 1..36: note = Synthetic
GKALNVAKDFVAEKIGATPAEAGQIPFDEFMNVLYS

SEQ ID NO: 3523 - protein, 22 aa, synthetic construct
  REGION 1..22: note = Synthetic
VSSFLEHVKRCVRHRNFHGTKK

SEQ ID NO: 3524 - protein, 34 aa, synthetic construct
  REGION 1..34: note = Synthetic
RFGRSAWGSWSKEQLNPQARQFWSLAAPQRFGKK

SEQ ID NO: 3525 - protein, 32 aa, synthetic construct
  REGION 1..32: note = Synthetic
EALEKFDKALKALPMHIRLAFNPTQLEGQCHV

SEQ ID NO: 3526 - protein, 16 aa, synthetic construct
  REGION 1..16: note = Synthetic
ALKHFTSLAKTWETAN

SEQ ID NO: 3527 - protein, 20 aa, synthetic construct
  REGION 1..20: note = Synthetic
AVEFLNKWITFCQSIYSTLT

SEQ ID NO: 3528 - protein, 38 aa, synthetic construct
  REGION 1..38: note = Synthetic
DKVREFFKRIKESDIPAKTRNWFSETLQKVKEKLRIES

SEQ ID NO: 3529 - protein, 16 aa, synthetic construct
  REGION 1..16: note = Synthetic
MVYTIDDLIDKLTTLG

SEQ ID NO: 3530 - protein, 20 aa, synthetic construct
  REGION 1..20: note = Synthetic
LAEQLVEKIKNLWYTKVLGY

SEQ ID NO: 3531 - protein, 30 aa, synthetic construct
  REGION 1..30: note = Synthetic
TLVGQLISLFAVVAAGPLVIVFLSARRGAL

SEQ ID NO: 3532 - protein, 37 aa, synthetic construct
  REGION 1..37: note = Synthetic
QCLSPMNHLCHKDADCSGKKRCCPSACGRDCRDPARG

SEQ ID NO: 3533 - protein, 25 aa, synthetic construct
  REGION 1..25: note = Synthetic
EVLALAKEAFTKSKDSGKLYQVIPN

SEQ ID NO: 3534 - protein, 23 aa, synthetic construct
  REGION 1..23: note = Synthetic
GTWHACCNGWQEGRGIRSVSISQ

SEQ ID NO: 3535 - protein, 31 aa, synthetic construct
  REGION 1..31: note = Synthetic
WQVLGQLIATGTIMLAGPAVIVLLALKKGNL

SEQ ID NO: 3536 - protein, 33 aa, synthetic construct
  REGION 1..33: note = Synthetic
VCHNMSTLLREVVEVEDITALIHLGSVMFEMDL

SEQ ID NO: 3537 - protein, 24 aa, synthetic construct
  REGION 1..24: note = Synthetic
VTEVLHQVEEVLKTDDNTYGGLLL

SEQ ID NO: 3538 - protein, 28 aa, synthetic construct
  REGION 1..28: note = Synthetic
LMSTLKGAATNVAVTLLNKLQCKLTGTC

SEQ ID NO: 3539 - protein, 25 aa, synthetic construct
  REGION 1..25: note = Synthetic
IDKAFDYIFEVVDYCVDYKYGLLLC

SEQ ID NO: 3540 - protein, 11 aa, synthetic construct
  REGION 1..11: note = Synthetic
CTRLYAHIPSC

SEQ ID NO: 3541 - protein, 17 aa, synthetic construct
  REGION 1..17: note = Synthetic
LKKLNQIVQKFHQLLQG

SEQ ID NO: 3542 - protein, 38 aa, synthetic construct
  REGION 1..38: note = Synthetic
RGCGGLMDGCDGKSTFCCSGFNCSPTWKWCVYARPGRR

SEQ ID NO: 3543 - protein, 38 aa, synthetic construct; identical to SEQ ID NO: 3542
  REGION 1..38: note = Synthetic

SEQ ID NO: 3544 - protein, 35 aa, synthetic construct
  REGION 1..35: note = Synthetic
QGMGKMERLLASYRGALEPSTPLGDLSGSLGHPVE

SEQ ID NO: 3545 - protein, 42 aa, synthetic construct
  REGION 1..42: note = Synthetic
CLKNLAGSVSGVNPGNAESLPGKCGVNVPYKISTSTNCATVK

SEQ ID NO: 3546 - protein, 22 aa, synthetic construct
  REGION 1..22: note = Synthetic
TNLMDFLSRLMSPEEKPAPAAK

SEQ ID NO: 3547 - protein, 31 aa, synthetic construct
  REGION 1..31: note = Synthetic
NKGMNEFKKILRTLAMPYTVIEVRTRDMCHV

SEQ ID NO: 3548 - protein, 31 aa, synthetic construct
  REGION 1..31: note = Synthetic
ASFLDNAKRYLQVLESKRNCCRRQICCGRTK

SEQ ID NO: 3549 - protein, 26 aa, synthetic construct
  REGION 1..26: note = Synthetic
IYKCVNHVCDSISKVTTDSKEYKNFP

SEQ ID NO: 3550 - protein, 18 aa, synthetic construct
  REGION 1..18: note = Synthetic
GAGQSVLNTLSCKLSKTC

SEQ ID NO: 3551 - protein, 18 aa, synthetic construct
  REGION 1..18: note = Synthetic
GAGQSVLNTLSCKLSKTC

SEQ ID NO: 3552 - protein, 24 aa, synthetic construct
  REGION 1..24: note = Synthetic
YKSGAQIGRNCFCLQKGVIYKREN

SEQ ID NO: 3553 - protein, 24 aa, synthetic construct
  REGION 1..24: note = Synthetic
YKSGAQIGRNCFCLQKGVIYKREN

SEQ ID NO: 3554 - protein, 18 aa, synthetic construct
  REGION 1..18: note = Synthetic
LKKYLEALDNFLNFKNKP

SEQ ID NO: 3555 - protein, 32 aa, synthetic construct; identical to SEQ ID NO: 3525
  REGION 1..32: note = Synthetic

SEQ ID NO: 3556 - protein, 24 aa, synthetic construct
  REGION 1..24: note = Synthetic
AVEKCATACSSFCTKGSTTKAETA

SEQ ID NO: 3557 - protein, 17 aa, synthetic construct
  REGION 1..17: note = Synthetic
LLDDVGNILNEVLNLLN

SEQ ID NO: 3558 - protein, 27 aa, synthetic construct
  REGION 1..27: note = Synthetic
DLQHAWNDAFDNLYYIVFSNLDGHPVA

SEQ ID NO: 3559 - protein, 38 aa, synthetic construct
  REGION 1..38: note = Synthetic
RGCGGLMAGCGGKSTFCCSGYNCSPTWKWCVYARPGRR

SEQ ID NO: 3560 - protein, 24 aa, synthetic construct
  REGION 1..24: note = Synthetic
LYGGCGGNANNFKTIKECESTCAA

SEQ ID NO: 3561 - protein, 41 aa, synthetic construct
  REGION 1..41: note = Synthetic
GLWKSAIGKLFSFGGLGVWTLVDVVLIAVGYIKPYDGSMYI

SEQ ID NO: 3562 - protein, 32 aa, synthetic construct
  REGION 1..32: note = Synthetic
REAEQAWKEMQEALREDHIKTKPEGSQLNHDI

SEQ ID NO: 3563 - protein, 14 aa, synthetic construct
  REGION 1..14: note = Synthetic
CDRIGGNFCTCVPN

SEQ ID NO: 3564 - protein, 24 aa, synthetic construct
  REGION 1..24: note = Synthetic
SLVEIINNAMYDVIYDYVNRTYVT

SEQ ID NO: 3565 - protein, 42 aa, synthetic construct
  REGION 1..42: note = Synthetic
CHRACGTCCARCNCVAPGTSGNYDKCPCYGSLTTHGGRRKCP

SEQ ID NO: 3566 - protein, 22 aa, synthetic construct
  REGION 1..22: note = Synthetic
TVVEFLSRWITFCQSAISTMTQ

SEQ ID NO: 3567 - protein, 22 aa, synthetic construct
  REGION 1..22: note = Synthetic
TVVEFLSRWITFCQSAISTMTQ

SEQ ID NO: 3568 - protein, 15 aa, synthetic construct
  REGION 1..15: note = Synthetic
VEDFVNSAQEIVETF

SEQ ID NO: 3569 - protein, 16 aa, synthetic construct
  REGION 1..16: note = Synthetic
KVAKKLVSHVAQKQLE

SEQ ID NO: 3570 - protein, 31 aa, synthetic construct
  REGION 1..31: note = Synthetic
DILDKVENAIHNAAQVGIGFAKPFEKLINPK

SEQ ID NO: 3571 - protein, 31 aa, synthetic construct; identical to SEQ ID NO: 3570
  REGION 1..31: note = Synthetic

SEQ ID NO: 3572 - protein, 12 aa, synthetic construct
  REGION 1..12: note = Synthetic
GLPKVMNDAGRR

SEQ ID NO: 3573 - protein, 34 aa, synthetic construct
  REGION 1..34: note = Synthetic
NFNEALKNGGTTLSKKTVLLLVIPFLVAAWSLHP

SEQ ID NO: 3574 - protein, 21 aa, synthetic construct
  REGION 1..21: note = Synthetic
ATLANEVKTMAEALVEEDMME

SEQ ID NO: 3575 - protein, 27 aa, synthetic construct
  REGION 1..27: note = Synthetic
HAFEFMQRALQDLKKTAYNLDTRVRKL

SEQ ID NO: 3576 - protein, 22 aa, synthetic construct
  REGION 1..22: note = Synthetic
QKMLTILHKILEKMVDKNYPKK

SEQ ID NO: 3577 - protein, 25 aa, synthetic construct
  REGION 1..25: note = Synthetic
WLAGCPSGWHNCKAHGPTIGWCCKK

SEQ ID NO: 3578 - protein, 33 aa, synthetic construct
  REGION 1..33: note = Synthetic
KSLKGYWSKFTDKFTGLWESGPEDQLTTPTLEP

SEQ ID NO: 3579 - protein, 26 aa, synthetic construct
  REGION 1..26: note = Synthetic
RLVDEARKLFDSMPYRSVVTWNALIA

SEQ ID NO: 3580 - protein, 26 aa, synthetic construct
  REGION 1..26: note = Synthetic
FTEALKKVKTLLNDIRRMMSSDEFED

SEQ ID NO: 3581 - protein, 20 aa, synthetic construct
  REGION 1..20: note = Synthetic
FCKAVMKSGGKINLKHRGKC

SEQ ID NO: 3582 - protein, 35 aa, synthetic construct
  REGION 1..35: note = Synthetic
VDSFQEIAKEIHHLAEPQHSESAFHQPCSPLSDLR

SEQ ID NO: 3583 - protein, 24 aa, synthetic construct
  REGION 1..24: note = Synthetic
IYGGCGGNANKFKTIEECHRTCVG

SEQ ID NO: 3584 - protein, 20 aa, synthetic construct
  REGION 1..20: note = Synthetic
LAEQLMEKIKNLWYTRVLGY

SEQ ID NO: 3585 - protein, 20 aa, synthetic construct
  REGION 1..20: note = Synthetic
LAEQLMEKIKNLWYTRVLGY

SEQ ID NO: 3586 - protein, 20 aa, synthetic construct
  REGION 1..20: note = Synthetic
LAEQLMEKIKNLWYTRVLGY

SEQ ID NO: 3587 - protein, 21 aa, synthetic construct
  REGION 1..21: note = Synthetic
KNIKEFLQSFVHIVQMFINPS

SEQ ID NO: 3588 - protein, 29 aa, synthetic construct
  REGION 1..29: note = Synthetic
EDCEQWWEDCQEALTCKVNWHKGWNWTSG

SEQ ID NO: 3589 - protein, 17 aa, synthetic construct
  REGION 1..17: note = Synthetic
MEECVSTCTNMVYDKRS

SEQ ID NO: 3590 - protein, 20 aa, synthetic construct
  REGION 1..20: note = Synthetic
LAEQLMEKIKNLWYTKVLGY

SEQ ID NO: 3591 - protein, 20 aa, synthetic construct
  REGION 1..20: note = Synthetic
LAEQLMEKIKNLWYTKVLGY

SEQ ID NO: 3592 - protein, 20 aa, synthetic construct
  REGION 1..20: note = Synthetic
LAEQLMEKIKNLWYTKVLGY

SEQ ID NO: 3593 - protein, 20 aa, synthetic construct
  REGION 1..20: note = Synthetic
LAEQLMEKIKNLWYTKVLGY

SEQ ID NO: 3594 - protein, 20 aa, synthetic construct
  REGION 1..20: note = Synthetic
LAEQLMEKIKNLWYTKVLGY

SEQ ID NO: 3595 - protein, 40 aa, synthetic construct
  REGION 1..40: note = Synthetic
LGGIFGIGGGAVFKQIQRAQILPSKCNMGVDCRFPSGYYW

SEQ ID NO: 3596 - protein, 12 aa, synthetic construct
  REGION 1..12: note = Synthetic
GLPKVMNDAGRR

SEQ ID NO: 3597 - protein, 24 aa, synthetic construct
  REGION 1..24: note = Synthetic
AVKKCIKTCSNLCTKGSVTAFQTA

SEQ ID NO: 3598 - protein, 21 aa, synthetic construct
  REGION 1..21: note = Synthetic
GWEKCTAVYTAVASCCRKKKG

SEQ ID NO: 3599 - protein, 21 aa, synthetic construct
  REGION 1..21: note = Synthetic
DNFGAQLQNLLKKKMILEMIN

SEQ ID NO: 3600 - protein, 12 aa, synthetic construct
  REGION 1..12: note = Synthetic
GLPKLLNDAGRK

SEQ ID NO: 3601 - protein, 12 aa, synthetic construct
  REGION 1..12: note = Synthetic
VLNSLDNLVSGL

SEQ ID NO: 3602 - protein, 42 aa, synthetic construct
  REGION 1..42: note = Synthetic
CIKSAAAGITGINFGLASGLPGKCGVNIPYKISPSTDCNSVK

SEQ ID NO: 3603 - protein, 42 aa, synthetic construct; identical to SEQ ID NO: 3602
  REGION 1..42: note = Synthetic

SEQ ID NO: 3604 - protein, 22 aa, synthetic construct
  REGION 1..22: note = Synthetic
WYSFLEELHSAFQQIAGEAESK

SEQ ID NO: 3605 - protein, 40 aa, synthetic construct
  REGION 1..40: note = Synthetic
KWVKAAIKTVDGRASTRKNMAETVPTGAQRSTSTAITLTG

SEQ ID NO: 3606 - protein, 13 aa, synthetic construct
  REGION 1..13: note = Synthetic
KSLREMAAAAFGR

SEQ ID NO: 3607 - protein, 13 aa, synthetic construct
  REGION 1..13: note = Synthetic
RALEKLASSFRCE

SEQ ID NO: 3608 - protein, 20 aa, synthetic construct
  REGION 1..20: note = Synthetic
AVYSSGFHKVFAEGTKLIVI

SEQ ID NO: 3609 - protein, 21 aa, synthetic construct
  REGION 1..21: note = Synthetic
NAVEFLNKWITFCQSIYSTMT

SEQ ID NO: 3610 - protein, 21 aa, synthetic construct
  REGION 1..21: note = Synthetic
NAVEFLNKWITFCQSIYSTMT

SEQ ID NO: 3611 - protein, 15 aa, synthetic construct
  REGION 1..15: note = Synthetic
VTRAPHVLNDLLLKF

SEQ ID NO: 3612 - protein, 16 aa, synthetic construct
  REGION 1..16: note = Synthetic
KVAKKLVSHVAQKQLE

SEQ ID NO: 3613 - protein, 31 aa, synthetic construct
  REGION 1..31: note = Synthetic
KQIMQAISEMMNECPDRDYQGWVDFGRRSAE

SEQ ID NO: 3614 - protein, 18 aa, synthetic construct
  REGION 1..18: note = Synthetic
RDAGKLLRSLKKLKLTTH

SEQ ID NO: 3615 - protein, 41 aa, synthetic construct
  REGION 1..41: note = Synthetic
DYYGDGAARLGYFPSSIVREDQTLKPAKTDVKTDIWDFYCQ

SEQ ID NO: 3616 - protein, 32 aa, synthetic construct
  REGION 1..32: note = Synthetic
VSQFCATLSELKCWINNICFWSTADKKCKPLH

SEQ ID NO: 3617 - protein, 21 aa, synthetic construct
  REGION 1..21: note = Synthetic
LLGQALTSLTTVDRTGNGAFW

SEQ ID NO: 3618 - protein, 21 aa, synthetic construct
  REGION 1..21: note = Synthetic
LLGQALTSLTTVDRTGNGAFW

SEQ ID NO: 3619 - protein, 21 aa, synthetic construct
  REGION 1..21: note = Synthetic
LLGQALTSLTTVDRTGNGAFW

SEQ ID NO: 3620 - protein, 21 aa, synthetic construct
  REGION 1..21: note = Synthetic
LLGQALTSLTTVDRTGNGAFW

SEQ ID NO: 3621 - protein, 20 aa, synthetic construct
  REGION 1..20: note = Synthetic
LAEQLMEKIRNLWYTKVLGY

SEQ ID NO: 3622 - protein, 24 aa, synthetic construct
  REGION 1..24: note = Synthetic
LKKGVQIARQCFCLEKDVVYKKHI

SEQ ID NO: 3623 - protein, 24 aa, synthetic construct
  REGION 1..24: note = Synthetic
LKKGVQIARQCFCLEKDVVYKKHI

SEQ ID NO: 3624 - protein, 20 aa, synthetic construct
  REGION 1..20: note = Synthetic
LLDFVTGVGKDIFAQLIKQI

SEQ ID NO: 3625 - protein, 20 aa, synthetic construct
  REGION 1..20: note = Synthetic
LAEQLMEKIKNLWYTKVLGY

SEQ ID NO: 3626 - protein, 20 aa, synthetic construct
  REGION 1..20: note = Synthetic
LAEQLMEKIKNLWYTKVLGY

SEQ ID NO: 3627 - protein, 20 aa, synthetic construct
  REGION 1..20: note = Synthetic
LAEQLMEKIKNLWYTKVLGY

SEQ ID NO: 3628 - protein, 34 aa, synthetic construct
  REGION 1..34: note = Synthetic
IHDLTTFLDTLIKSCHDPLPTWETISNETINWEK

SEQ ID NO: 3629 - protein, 35 aa, synthetic construct
  REGION 1..35: note = Synthetic
RLCRHFVHELKQALTSEMAAKHHQELDKPPLYDEE

SEQ ID NO: 3630 - protein, 11 aa, synthetic construct
  REGION 1..11: note = Synthetic
EVCDGFCRLWE

SEQ ID NO: 3631 - protein, 28 aa, synthetic construct
  REGION 1..28: note = Synthetic
VVTLMDDVMDALTRLIKKTEEDLKKMNR

SEQ ID NO: 3632 - protein, 23 aa, synthetic construct
  REGION 1..23: note = Synthetic
LAHRCSKAIDDAEELVKVMAEKQ

SEQ ID NO: 3633 - protein, 23 aa, synthetic construct
  REGION 1..23: note = Synthetic
LAHRCSKAIDDAEELVKVMAEKQ

SEQ ID NO: 3634 - protein, 41 aa, synthetic construct
  REGION 1..41: note = Synthetic
ISQGNGGLSKFNQNGLEMKNLSFVKLIGVSFIAFISFILLI

SEQ ID NO: 3635 - protein, 41 aa, synthetic construct; identical to SEQ ID NO: 3634
  REGION 1..41: note = Synthetic

SEQ ID NO: 3636 - protein, 35 aa, synthetic construct
  REGION 1..35: note = Synthetic
RLCRHFVHELKQALTSEMAAKHHQDLDKPPLYDEE

SEQ ID NO: 3637 - protein, 17 aa, synthetic construct
  REGION 1..17: note = Synthetic
KRAADALTKAATAVESH

SEQ ID NO: 3638 - protein, 27 aa, synthetic construct
  REGION 1..27: note = Synthetic
AENLVESFQEIANEMEKFGEAERSECS

SEQ ID NO: 3639 - protein, 22 aa, synthetic construct
  REGION 1..22: note = Synthetic
DNVAAAWNKALDNTFAIVVPRL

SEQ ID NO: 3640 - protein, 22 aa, synthetic construct
  REGION 1..22: note = Synthetic
DNVAAAWNKALDNTFAIVVPRL

SEQ ID NO: 3641 - protein, 21 aa, synthetic construct
  REGION 1..21: note = Synthetic
IKDVEEVVSDIIDKVTDAEKN

SEQ ID NO: 3642 - protein, 20 aa, synthetic construct
  REGION 1..20: note = Synthetic
LAEQLMEKIKNLWYTRVLGY

SEQ ID NO: 3643 - protein, 20 aa, synthetic construct
  REGION 1..20: note = Synthetic
LAEQLMEKIKNLWYTRVLGY

SEQ ID NO: 3644 - protein, 20 aa, synthetic construct
  REGION 1..20: note = Synthetic
LAEQLMEKIKNLWYTRVLGY

SEQ ID NO: 3645 - protein, 20 aa, synthetic construct
  REGION 1..20: note = Synthetic
LAEQLMEKIKNLWYTRVLGY

SEQ ID NO: 3646 - protein, 20 aa, synthetic construct
  REGION 1..20: note = Synthetic
LAEQLMEKIKNLWYTRVLGY

SEQ ID NO: 3647 - protein, 16 aa, synthetic construct
  REGION 1..16: note = Synthetic
IGECVKDVLYNCHTIL

SEQ ID NO: 3648 - protein, 15 aa, synthetic construct
  REGION 1..15: note = Synthetic
QFFDAYKTYCKNSRI

SEQ ID NO: 3649 - protein, 17 aa, synthetic construct
  REGION 1..17: note = Synthetic
WDHAVQRVDEMLDELMH

SEQ ID NO: 3650 - protein, 20 aa, synthetic construct
  REGION 1..20: note = Synthetic
LAEQLMEKIKNLWYTKVLGY

SEQ ID NO: 3651 - protein, 20 aa, synthetic construct
  REGION 1..20: note = Synthetic
LAEQLMEKIKNLWYTKVLGY

SEQ ID NO: 3652 - protein, 24 aa, synthetic construct
  REGION 1..24: note = Synthetic
YKSGAQIGRNCFCLQKGVIYKREN

SEQ ID NO: 3653 - protein, 30 aa, synthetic construct
  REGION 1..30: note = Synthetic
ILDKMENAIHKAAQAGIGLAKPIENMILPK

SEQ ID NO: 3654 - protein, 26 aa, synthetic construct
  REGION 1..26: note = Synthetic
NHAVDRCNEACYRFCTNEAEIVTVAS

SEQ ID NO: 3655 - protein, 37 aa, synthetic construct
  REGION 1..37: note = Synthetic
FKGARDCGGQGKGCYTQPCCPGLRCRGGGTGGGVCQP

SEQ ID NO: 3656 - protein, 24 aa, synthetic construct
  REGION 1..24: note = Synthetic
FLRELISNASDACDKKRIGLENEK

SEQ ID NO: 3657 - protein, 30 aa, synthetic construct
  REGION 1..30: note = Synthetic
GKEGMGAWPTWSRYCQYSDTLARWLDGCKL

SEQ ID NO: 3658 - protein, 42 aa, synthetic construct
  REGION 1..42: note = Synthetic
CLKNLAGSISGVNPNNAAGLPGKCGVNVPYKISTSTNCATVK

SEQ ID NO: 3659 - protein, 39 aa, synthetic construct
  REGION 1..39: note = Synthetic
RLIDAMRNFGDTRSCGRRGKPCPCCRGFRCTGSFCRKWQ

SEQ ID NO: 3660 - protein, 29 aa, synthetic construct
  REGION 1..29: note = Synthetic
SSLKDYWSSFKGKFTDFWESATSPTQSPP

SEQ ID NO: 3661 - protein, 13 aa, synthetic construct
  REGION 1..13: note = Synthetic
AGPVSKLVSGIGL

SEQ ID NO: 3662 - protein, 17 aa, synthetic construct
  REGION 1..17: note = Synthetic
VDNIRSILDYISRLLGE

SEQ ID NO: 3663 - protein, 17 aa, synthetic construct
  REGION 1..17: note = Synthetic
VDNIRSILDYISRLLGE

SEQ ID NO: 3664 - protein, 27 aa, synthetic construct
  REGION 1..27: note = Synthetic
ADQAANEWGRSGKDPNHFRPAGLPSKY

SEQ ID NO: 3665 - protein, 39 aa, synthetic construct
  REGION 1..39: note = Synthetic
CVKKWEGGGRRVTQYCSHACAIPASYEFVHCCQTDKCNG

SEQ ID NO: 3666 - protein, 14 aa, synthetic construct
  REGION 1..14: note = Synthetic
LKEFAGGLVTGVQS

SEQ ID NO: 3667 - protein, 35 aa, synthetic construct
  REGION 1..35: note = Synthetic
IIENLLSIFKEWVSKKMFHYPPQDLVQVYRRISFN

SEQ ID NO: 3668 - protein, 32 aa, synthetic construct
  REGION 1..32: note = Synthetic
TTAFSSVTHICRDVNYGWLIRYMHANGASMFF

SEQ ID NO: 3669 - protein, 32 aa, synthetic construct; identical to SEQ ID NO: 3668
  REGION 1..32: note = Synthetic

SEQ ID NO: 3670 - protein, 32 aa, synthetic construct; identical to SEQ ID NO: 3668
  REGION 1..32: note = Synthetic

SEQ ID NO: 3671 - protein, 24 aa, synthetic construct
  REGION 1..24: note = Synthetic
FTYFFDRAVERIQDIISSYTMIPL

SEQ ID NO: 3672 - protein, 34 aa, synthetic construct
  REGION 1..34: note = Synthetic
KRFLSTLLNVASKVVPTLFCKITKKMLKLRLEII

SEQ ID NO: 3673 - protein, 21 aa, synthetic construct
  REGION 1..21: note = Synthetic
LGKAWDTAFDKMYSIVFTKLH

SEQ ID NO: 3674 - protein, 42 aa, synthetic construct
  REGION 1..42: note = Synthetic
CLKNVAGSISGLNAGNAASIPSKCGVSIPYTISPSIDCSSVN

SEQ ID NO: 3675 - protein, 42 aa, synthetic construct; identical to SEQ ID NO: 3674
  REGION 1..42: note = Synthetic

SEQ ID NO: 3676 - protein, 42 aa, synthetic construct; identical to SEQ ID NO: 3674
  REGION 1..42: note = Synthetic

SEQ ID NO: 3677 - protein, 24 aa, synthetic construct
  REGION 1..24: note = Synthetic
YKSGAQIGRNCFCLQKGVIYKREN

SEQ ID NO: 3678 - protein, 24 aa, synthetic construct
  REGION 1..24: note = Synthetic
YKSGAQIGRNCFCLQKGVIYKREN

SEQ ID NO: 3679 - protein, 24 aa, synthetic construct
  REGION 1..24: note = Synthetic
YKSGAQIGRNCFCLQKGVIYKREN

SEQ ID NO: 3680 - protein, 24 aa, synthetic construct
  REGION 1..24: note = Synthetic
YKSGAQIGRNCFCLQKGVIYKREN

SEQ ID NO: 3681 - protein, 24 aa, synthetic construct
  REGION 1..24: note = Synthetic
YKSGAQIGRNCFCLQKGVIYKREN

SEQ ID NO: 3682 - protein, 24 aa, synthetic construct
  REGION 1..24: note = Synthetic
YKSGAQIGRNCFCLQKGVIYKREN

SEQ ID NO: 3683 - protein, 12 aa, synthetic construct
  REGION 1..12: note = Synthetic
FQEAYRRFYGPV

SEQ ID NO: 3684 - protein, 12 aa, synthetic construct
  REGION 1..12: note = Synthetic
FQEAYRRFYGPV

SEQ ID NO: 3685 - protein, 12 aa, synthetic construct
  REGION 1..12: note = Synthetic
FQEAYRRFYGPV

SEQ ID NO: 3686 - protein, 23 aa, synthetic construct
  REGION 1..23: note = Synthetic
CSRCCSYAGQAVQTQQQSTEPGH

SEQ ID NO: 3687 - protein, 36 aa, synthetic construct
  REGION 1..36: note = Synthetic
KSITKCMEKAPEELCAYSFRLVMCAFKAGHPVIDSE

SEQ ID NO: 3688 - protein, 38 aa, synthetic construct
  REGION 1..38: note = Synthetic
TEWCRLFEGFCHDKNCPPPTSHVGSCHPEKRSCCKDRR

SEQ ID NO: 3689 - protein, 32 aa, synthetic construct
  REGION 1..32: note = Synthetic
LGKRGLNDLSDLDELFDGEISKADLDFLREIM

SEQ ID NO: 3690 - protein, 19 aa, synthetic construct
  REGION 1..19: note = Synthetic
GWHKCIATYTAVASCCKKD

SEQ ID NO: 3691 - protein, 31 aa, synthetic construct
  REGION 1..31: note = Synthetic
GMKTVRGCADTCANPGENEKVTYCSTDNCNS

SEQ ID NO: 3692 - protein, 42 aa, synthetic construct
  REGION 1..42: note = Synthetic
ITQAVACAKRVVSDPQGIRAWVAWRSHCQNQDLTSYIQGCGV

SEQ ID NO: 3693 - protein, 23 aa, synthetic construct
  REGION 1..23: note = Synthetic
GQALGKFLQDVLWEEADEVLADE

SEQ ID NO: 3694 - protein, 27 aa, synthetic construct
  REGION 1..27: note = Synthetic
LTTVLDQYSNYKPMGWKCHCNGHFYNP

SEQ ID NO: 3695 - protein, 18 aa, synthetic construct
  REGION 1..18: note = Synthetic
LRTVTELLKKVVDAAKKD

SEQ ID NO: 3696 - protein, 29 aa, synthetic construct
  REGION 1..29: note = Synthetic
ECDRIGAQCFADKRSTFNRSLISYTKDKC

SEQ ID NO: 3697 - protein, 31 aa, synthetic construct
  REGION 1..31: note = Synthetic
DKCTTFCRSLPNKYDFGVCDKIYACCCHINV

SEQ ID NO: 3698 - protein, 40 aa, synthetic construct
  REGION 1..40: note = Synthetic
SYVGDCGSNGGSCVSSYCPYGNRLNYFCPLGRTCCRHAYV

SEQ ID NO: 3699 - protein, 17 aa, synthetic construct
  REGION 1..17: note = Synthetic
EEVDEILRKAEEDREDM

SEQ ID NO: 3700 - protein, 24 aa, synthetic construct
  REGION 1..24: note = Synthetic
AVEKCANVCSTVCTKGSMNAVEIA

SEQ ID NO: 3701 - protein, 18 aa, synthetic construct
  REGION 1..18: note = Synthetic
GIYNDCCNACDPAKKTCT

SEQ ID NO: 3702 - protein, 24 aa, synthetic construct
  REGION 1..24: note = Synthetic
CDECCKKAGDRAGTCEYFKCKCNP

SEQ ID NO: 3703 - protein, 41 aa, synthetic construct
  REGION 1..41: note = Synthetic
NTLARNCYNACRFTGGSQPTCGILCDCIHVTTTTCPSSHPS

SEQ ID NO: 3704 - protein, 26 aa, synthetic construct
  REGION 1..26: note = Synthetic
VDECQQVLHNLVSACPQASIFSRLQE

SEQ ID NO: 3705 - protein, 33 aa, synthetic construct
  REGION 1..33: note = Synthetic
AAKDGGGKIKNYEAVVVEKLWLHSKSLESFKAL

SEQ ID NO: 3706 - protein, 34 aa, synthetic construct
  REGION 1..34: note = Synthetic
DCAKLIRSLIEIADQLDDDLDATPEELCKFVYFC

SEQ ID NO: 3707 - protein, 14 aa, synthetic construct
  REGION 1..14: note = Synthetic
IFRNLPDLVETIMQ

SEQ ID NO: 3708 - protein, 23 aa, synthetic construct
  REGION 1..23: note = Synthetic
SQFEDFVKDLERLVQLINASGDK

SEQ ID NO: 3709 - protein, 40 aa, synthetic construct
  REGION 1..40: note = Synthetic
DVLEEFGKTLEDNVREFINLITQSELPAKTRDWFSEIFGK

SEQ ID NO: 3710 - protein, 17 aa, synthetic construct
  REGION 1..17: note = Synthetic
LDNIRSILDYISKLLGE

SEQ ID NO: 3711 - protein, 24 aa, synthetic construct
  REGION 1..24: note = Synthetic
VVERCNEACYHFCNKKADIVTVVS

SEQ ID NO: 3712 - protein, 24 aa, synthetic construct
  REGION 1..24: note = Synthetic
VVERCNEACYHFCNKKADIVTVVS

SEQ ID NO: 3713 - protein, 42 aa, synthetic construct
  REGION 1..42: note = Synthetic
GMFNKAYRKALGQLSARKYLHTLMAKRVGGGSMIEDDNEPLS

SEQ ID NO: 3714 - protein, 23 aa, synthetic construct
  REGION 1..23: note = Synthetic
EEIKRVVEKMFKKFRCGLSGNDC

SEQ ID NO: 3715 - protein, 24 aa, synthetic construct
  REGION 1..24: note = Synthetic
DNVAAAWTHALDNVYTAVFQIVTA

SEQ ID NO: 3716 - protein, 31 aa, synthetic construct
  REGION 1..31: note = Synthetic
DNLVDALTRLARGLKAQTSPEQLCGLLKICK

SEQ ID NO: 3717 - protein, 19 aa, synthetic construct
  REGION 1..19: note = Synthetic
NGLISLMTTMAATPVSPTT

SEQ ID NO: 3718 - protein, 21 aa, synthetic construct
  REGION 1..21: note = Synthetic
ALQKYLESILGSSTSPRPPSS

SEQ ID NO: 3719 - protein, 21 aa, synthetic construct
  REGION 1..21: note = Synthetic
ALQKYLESILGSSTSPRPPSS

SEQ ID NO: 3720 - protein, 26 aa, synthetic construct
  REGION 1..26: note = Synthetic
VLKLWNSVLKHICNLSNDIKRIIKQS

SEQ ID NO: 3721 - protein, 14 aa, synthetic construct
  REGION 1..14: note = Synthetic
GCWAKYKHLCGRKR

SEQ ID NO: 3722 - protein, 27 aa, synthetic construct
  REGION 1..27: note = Synthetic
ADQAANEWGRSGKDPNHFRPPGLPDKY

SEQ ID NO: 3723 - protein, 27 aa, synthetic construct
  REGION 1..27: note = Synthetic
ADQAANEWGRSGKDPNHFRPSGLPDKY

SEQ ID NO: 3724 - protein, 32 aa, synthetic construct
  REGION 1..32: note = Synthetic
GGDVFKQIQRAQILPSKCNMGADCKFPSGYYW

SEQ ID NO: 3725 - protein, 37 aa, synthetic construct
  REGION 1..37: note = Synthetic
RECGGLMTRCDGKTTFCCSGMNCSPTWKWCVYAPGRR

SEQ ID NO: 3726 - protein, 32 aa, synthetic construct
  REGION 1..32: note = Synthetic
VEEVWNKCVNFCTDNGARLGYCFGVACHCLYY

SEQ ID NO: 3727 - protein, 25 aa, synthetic construct
  REGION 1..25: note = Synthetic
GLLSVLGSVVKHVIPHVVPVIAEHL

SEQ ID NO: 3728 - protein, 29 aa, synthetic construct
  REGION 1..29: note = Synthetic
FHDCEDAARELQSQIQEARADLARRGLRF

SEQ ID NO: 3729 - protein, 20 aa, synthetic construct
  REGION 1..20: note = Synthetic
AVEFLNKWITFCQSIYSTLT

SEQ ID NO: 3730 - protein, 20 aa, synthetic construct
  REGION 1..20: note = Synthetic
AVEFLNKWITFCQSIYSTLT

SEQ ID NO: 3731 - protein, 37 aa, synthetic construct
  REGION 1..37: note = Synthetic
HCLSPMNHLCHKDSDCSGKKRCCHSACGRDCRDPARG

SEQ ID NO: 3732 - protein, 33 aa, synthetic construct
  REGION 1..33: note = Synthetic
EEIMEKFRRALQPLPGRVQIVPDLTRMAERCRI

SEQ ID NO: 3733 - protein, 15 aa, synthetic construct
  REGION 1..15: note = Synthetic
CGDAHHFYRGCTCTC

SEQ ID NO: 3734 - protein, 24 aa, synthetic construct
  REGION 1..24: note = Synthetic
AVERCNEACYHFCNKEADIVTIVS

SEQ ID NO: 3735 - protein, 12 aa, synthetic construct
  REGION 1..12: note = Synthetic
FQDAYRRFYGTV

SEQ ID NO: 3736 - protein, 26 aa, synthetic construct
  REGION 1..26: note = Synthetic
DLCEAACKDLGKPMDFCKDGTCKCKD

SEQ ID NO: 3737 - protein, 42 aa, synthetic construct
  REGION 1..42: note = Synthetic
ALKEAKDLIEGLPKKVKEGVSKDEAEDAKKQLEEVGAKVSIA

SEQ ID NO: 3738 - protein, 21 aa, synthetic construct
  REGION 1..21: note = Synthetic
ATEWLKNLVEIAEKQQKAAPK

SEQ ID NO: 3739 - protein, 12 aa, synthetic construct
  REGION 1..12: note = Synthetic
EAYEKYIKSIEE

SEQ ID NO: 3740 - protein, 42 aa, synthetic construct
  REGION 1..42: note = Synthetic
CLKGIARGIHNLNLNNAASIPSKCNVNVPYTISPDIDCSRIY

SEQ ID NO: 3741 - protein, 31 aa, synthetic construct
  REGION 1..31: note = Synthetic
FEQVKEMLNNLFEAADDNTGQLHLNLGNDDL

SEQ ID NO: 3742 - protein, 12 aa, synthetic construct
  REGION 1..12: note = Synthetic
FQEAYRRFYGPV

SEQ ID NO: 3743 - protein, 12 aa, synthetic construct
  REGION 1..12: note = Synthetic
FQEAYRRFYGPV

SEQ ID NO: 3744 - protein, 12 aa, synthetic construct
  REGION 1..12: note = Synthetic
FQEAYRRFYGPV

SEQ ID NO: 3745 - protein, 12 aa, synthetic construct
  REGION 1..12: note = Synthetic
FQEAYRRFYGPV

SEQ ID NO: 3746 - protein, 12 aa, synthetic construct
  REGION 1..12: note = Synthetic
FQEAYRRFYGPV

SEQ ID NO: 3747 - protein, 12 aa, synthetic construct
  REGION 1..12: note = Synthetic
FQEAYRRFYGPV

SEQ ID NO: 3748 - protein, 12 aa, synthetic construct
  REGION 1..12: note = Synthetic
FQEAYRRFYGPV

SEQ ID NO: 3749 - protein, 12 aa, synthetic construct
  REGION 1..12: note = Synthetic
FQEAYRRFYGPV

SEQ ID NO: 3750 - protein, 26 aa, synthetic construct
  REGION 1..26: note = Synthetic
KRFLSTLLNVASKVVPTLFCKITKKC

SEQ ID NO: 3751 - protein, 26 aa, synthetic construct
  REGION 1..26: note = Synthetic
KRFLSTLLNVASKVVPTLFCKITKKC

SEQ ID NO: 3752 - protein, 17 aa, synthetic construct
  REGION 1..17: note = Synthetic
ILDVITDAVNSAMNAMG

SEQ ID NO: 3753 - protein, 31 aa, synthetic construct
  REGION 1..31: note = Synthetic
STAFSSVTHICRDVNYGWLIRYMHANGASMF

SEQ ID NO: 3754 - protein, 31 aa, synthetic construct
  REGION 1..31: note = Synthetic
GMKTVRGCAKTCATPGENEKITYCSTDNCNI

SEQ ID NO: 3755 - protein, 15 aa, synthetic construct
  REGION 1..15: note = Synthetic
LKCLNGVCTKVTPRR

SEQ ID NO: 3756 - protein, 26 aa, synthetic construct
  REGION 1..26: note = Synthetic
TTAFSSVTHICRDVNYGWLIRYMHAN

SEQ ID NO: 3757 - protein, 21 aa, synthetic construct
  REGION 1..21: note = Synthetic
KNIKEFLQSFVHIVQMFINTS

SEQ ID NO: 3758 - protein, 30 aa, synthetic construct
  REGION 1..30: note = Synthetic
RGIATFMTDLVEGSKYFRVKMDIKLYECYY

SEQ ID NO: 3759 - protein, 29 aa, synthetic construct
  REGION 1..29: note = Synthetic
KVQRILDKFMESLSEKQKKEFGDLYFDKV

SEQ ID NO: 3760 - protein, 26 aa, synthetic construct
  REGION 1..26: note = Synthetic
QQIQAIMDSLSESVRREIINALSPQE

SEQ ID NO: 3761 - protein, 29 aa, synthetic construct
  REGION 1..29: note = Synthetic
ARAAAKTAADALAAAKKTAADAAAAAAAA

SEQ ID NO: 3762 - protein, 24 aa, synthetic construct
  REGION 1..24: note = Synthetic
VLNALGQAWNAVGNSISRYYCDAE

SEQ ID NO: 3763 - protein, 29 aa, synthetic construct
  REGION 1..29: note = Synthetic
SADQAARSAMNRPPGCCNNPACVKHRCGG

SEQ ID NO: 3764 - protein, 31 aa, synthetic construct
  REGION 1..31: note = Synthetic
FYGGCYGNANNFKEINECDRRCVSPDINKPG

SEQ ID NO: 3765 - protein, 18 aa, synthetic construct
  REGION 1..18: note = Synthetic
AKNAIGKCDDFKCQCLNS

SEQ ID NO: 3766 - protein, 33 aa, synthetic construct
  REGION 1..33: note = Synthetic
FSSLKDYWSTVKDKFSEFWDLDPEVRPTSAVAA

SEQ ID NO: 3767 - protein, 42 aa, synthetic construct
  REGION 1..42: note = Synthetic
CLKNAARGIRGLNVGKAASIPSKCGVSIPYTISTSTDCSRVS

SEQ ID NO: 3768 - protein, 12 aa, synthetic construct
  REGION 1..12: note = Synthetic
VAFFKAVGATIM

SEQ ID NO: 3769 - protein, 31 aa, synthetic construct
  REGION 1..31: note = Synthetic
TLEDAAKSAADKVKRSLSDDDDREKKHPKEL

SEQ ID NO: 3770 - protein, 28 aa, synthetic construct
  REGION 1..28: note = Synthetic
TNYEGGGEDVFEDGKRRVFTGPNPLHNR

SEQ ID NO: 3771 - protein, 23 aa, synthetic construct
  REGION 1..23: note = Synthetic
GNCGDGWKKCRSVNAIFNCCQRV

SEQ ID NO: 3772 - protein, 30 aa, synthetic construct
  REGION 1..30: note = Synthetic
LSSVYGNGKSILRGILRKGICCGVSFCYPC

SEQ ID NO: 3773 - protein, 21 aa, synthetic construct
  REGION 1..21: note = Synthetic
AGWEKCASYYTIIADCCRKKK

SEQ ID NO: 3774 - protein, 42 aa, synthetic construct
  REGION 1..42: note = Synthetic
KLCSNGGTKCTHHCGKNNTVGICHGQNGNLKCECVEYKRKMF

SEQ ID NO: 3775 - protein, 17 aa, synthetic construct
  REGION 1..17: note = Synthetic
TAAGHLGSVLAAKQSGW

SEQ ID NO: 3776 - protein, 27 aa, synthetic construct
  REGION 1..27: note = Synthetic
GESCCTGICKWVFFTSKFMCRRVWGKD

SEQ ID NO: 3777 - protein, 31 aa, synthetic construct
  REGION 1..31: note = Synthetic
FKKWLQTVAEAAEELKNMVEKVANGDSGKTN

SEQ ID NO: 3778 - protein, 42 aa, synthetic construct
  REGION 1..42: note = Synthetic
CLKSLATSIKGINMGKVSGVPGKCGVSVPFPISMSTDCNKVH

SEQ ID NO: 3779 - protein, 15 aa, synthetic construct
  REGION 1..15: note = Synthetic
TALRRYNQWATGHFM

SEQ ID NO: 3780 - protein, 33 aa, synthetic construct
  REGION 1..33: note = Synthetic
LGKRGLKNLDQYNDLFDGEISDADIKFLKDLMR

SEQ ID NO: 3781 - protein, 29 aa, synthetic construct
  REGION 1..29: note = Synthetic
VEDAIRKFVRWLVQKYGINIHDLIDHFKH

SEQ ID NO: 3782 - protein, 27 aa, synthetic construct
  REGION 1..27: note = Synthetic
ADQAANEWGRSGKDPNHFRPAGLPDKY

SEQ ID NO: 3783 - protein, 29 aa, synthetic construct
  REGION 1..29: note = Synthetic
EVMNKAVEKCTKACSTFCTKGSKIAVKTA

SEQ ID NO: 3784 - protein, 29 aa, synthetic construct
  REGION 1..29: note = Synthetic
ILDKFLKEFSSVFHHSKMSTSTGAWSNLV

SEQ ID NO: 3785 - protein, 24 aa, synthetic construct
  REGION 1..24: note = Synthetic
LKKGVQIARQCFCSEKDVIYKKDI

SEQ ID NO: 3786 - protein, 29 aa, synthetic construct
  REGION 1..29: note = Synthetic
SSLKDYWSTFKGKFTDFWDYTPKPEPSSS

SEQ ID NO: 3787 - protein, 32 aa, synthetic construct
  REGION 1..32: note = Synthetic
RFLKGYWSKFTDKFTGFWDSNPEDQPTPAIES

SEQ ID NO: 3788 - protein, 19 aa, synthetic construct
  REGION 1..19: note = Synthetic
VINNLAKGLDEIVSKVLGQ

SEQ ID NO: 3789 - protein, 41 aa, synthetic construct
  REGION 1..41: note = Synthetic
YKNVIERFIKNCFGLEKETNYRTWFNLSCGDDYPFVCKSPA

SEQ ID NO: 3790 - protein, 41 aa, synthetic construct; identical to SEQ ID NO: 3789
  REGION 1..41: note = Synthetic

SEQ ID NO: 3791 - protein, 31 aa, synthetic construct
  REGION 1..31: note = Synthetic
TLEDAAKSAAETVRTFSESDENRETQHQNEL

SEQ ID NO: 3792 - protein, 29 aa, synthetic construct
  REGION 1..29: note = Synthetic
KMIQTGAENLAEEAETLAAALLEEEMMDN

SEQ ID NO: 3793 - protein, 22 aa, synthetic construct
  REGION 1..22: note = Synthetic
DNVAAAWNKALDNTYAIVVPRL

SEQ ID NO: 3794 - protein, 33 aa, synthetic construct
  REGION 1..33: note = Synthetic
TAFNNIVKTFTDALTKMMPPPSSGAPSNGAPAQ

SEQ ID NO: 3795 - protein, 28 aa, synthetic construct
  REGION 1..28: note = Synthetic
NDVNHAWDDAFDKMYFVVFSALEGHPVS

SEQ ID NO: 3796 - protein, 24 aa, synthetic construct
  REGION 1..24: note = Synthetic
AVEKCANACSTVCTKGSVNAVEIA

SEQ ID NO: 3797 - protein, 24 aa, synthetic construct
  REGION 1..24: note = Synthetic
AVEKCANACSTVCTKGSVNAVEIA

SEQ ID NO: 3798 - protein, 28 aa, synthetic construct
  REGION 1..28: note = Synthetic
LLKNLLNQVTTLVNEAALNESSNVKQTQ

SEQ ID NO: 3799 - protein, 17 aa, synthetic construct
  REGION 1..17: note = Synthetic
FCQACWNSARTCGPYVG

SEQ ID NO: 3800 - protein, 22 aa, synthetic construct
  REGION 1..22: note = Synthetic
DNVAAAWNKALDNTYAIVVPRL

SEQ ID NO: 3801 - protein, 18 aa, synthetic construct
  REGION 1..18: note = Synthetic
LDRVCEECYQLFRESDVH

SEQ ID NO: 3802 - protein, 27 aa, synthetic construct
  REGION 1..27: note = Synthetic
GGGGKKCGGYGGGYGSGVIIGAERPKK

SEQ ID NO: 3803 - protein, 12 aa, synthetic construct
  REGION 1..12: note = Synthetic
GISALMNEAGRR

SEQ ID NO: 3804 - protein, 12 aa, synthetic construct
  REGION 1..12: note = Synthetic
EAYEKYIKSIEE

SEQ ID NO: 3805 - protein, 15 aa, synthetic construct
  REGION 1..15: note = Synthetic
VLYQLWEWFSSFLHQ

SEQ ID NO: 3806 - protein, 41 aa, synthetic construct
  REGION 1..41: note = Synthetic
QCLNNLLSTWDPSVRLSPVSCNCTPQPNNNILCSCPNMICP

SEQ ID NO: 3807 - protein, 42 aa, synthetic construct
  REGION 1..42: note = Synthetic
CLKSLATSIKSINMGKVSGVPGKCGVSVPFPISMSTNCNNVN

SEQ ID NO: 3808 - protein, 12 aa, synthetic construct
  REGION 1..12: note = Synthetic
FQEAYRRFYGPV

SEQ ID NO: 3809 - protein, 24 aa, synthetic construct
  REGION 1..24: note = Synthetic
LLDIVTGLLGNLIVDVLKPKTPAS

SEQ ID NO: 3810 - protein, 24 aa, synthetic construct
  REGION 1..24: note = Synthetic
LLDIVTGLLGNLIVDVLKPKTPAS

SEQ ID NO: 3811 - protein, 36 aa, synthetic construct
  REGION 1..36: note = Synthetic
TCVDSMADPVRVKRVWPLVIRTVIAGYNLYRAIKKK

SEQ ID NO: 3812 - protein, 24 aa, synthetic construct
  REGION 1..24: note = Synthetic
LKKGVQIARQCFCSEKDVIYKKDI

SEQ ID NO: 3813 - protein, 24 aa, synthetic construct
  REGION 1..24: note = Synthetic
LKKGVQIARQCFCSEKDVIYKKDI

SEQ ID NO: 3814 - protein, 41 aa, synthetic construct
  REGION 1..41: note = Synthetic
DIIDNVENAIHKAAKTGIGMVKPIENIFIPNQQKKSTEASN

SEQ ID NO: 3815 - protein, 12 aa, synthetic construct
  REGION 1..12: note = Synthetic
FYGSYSGLGSSL

SEQ ID NO: 3816 - protein, 12 aa, synthetic construct
  REGION 1..12: note = Synthetic
FYGSYSGLGSSL

SEQ ID NO: 3817 - protein, 29 aa, synthetic construct
  REGION 1..29: note = Synthetic
TTAFSSVTHICRDVNYGWIIRYMHANGAS

SEQ ID NO: 3818 - protein, 29 aa, synthetic construct
  REGION 1..29: note = Synthetic
TTAFSSVTHICRDVNYGWIIRYMHANGAS

SEQ ID NO: 3819 - protein, 29 aa, synthetic construct
  REGION 1..29: note = Synthetic
TTAFSSVTHICRDVNYGWIIRYLHANGAS

SEQ ID NO: 3820 - protein, 35 aa, synthetic construct
  REGION 1..35: note = Synthetic
IISSFKSFISTISKVSNSIILGLMTLIVFVYLILI

SEQ ID NO: 3821 - protein, 18 aa, synthetic construct
  REGION 1..18: note = Synthetic
LKKFLQFIYYCCNICLSE

SEQ ID NO: 3822 - protein, 18 aa, synthetic construct
  REGION 1..18: note = Synthetic
VSTLLTVMSTAFSGLGVL

SEQ ID NO: 3823 - protein, 12 aa, synthetic construct
  REGION 1..12: note = Synthetic
VLNSLDNLVSGL

SEQ ID NO: 3824 - protein, 35 aa, synthetic construct
  REGION 1..35: note = Synthetic
WSQAMKPLEDAADYMRSQGVSESAIKHFIAAYFNH

SEQ ID NO: 3825 - protein, 42 aa, synthetic construct
  REGION 1..42: note = Synthetic
FDEFHEAFHNFLHTHSVWNDNVDAAWHCNEKEIRKVINANLE

SEQ ID NO: 3826 - protein, 25 aa, synthetic construct
  REGION 1..25: note = Synthetic
QEANRWGRSGKDPNRYRPKGLDPKY

SEQ ID NO: 3827 - protein, 27 aa, synthetic construct
  REGION 1..27: note = Synthetic
KECWAPCKAAVGTDRGKCMGKKCRCYG

SEQ ID NO: 3828 - protein, 37 aa, synthetic construct
  REGION 1..37: note = Synthetic
RDCRALYGGCTKDEDCCKHLACRRTLPTYCAWDLTFP

SEQ ID NO: 3829 - protein, 37 aa, synthetic construct; identical to SEQ ID NO: 3828
  REGION 1..37: note = Synthetic

SEQ ID NO: 3830 - protein, 33 aa, synthetic construct
  REGION 1..33: note = Synthetic
CGSDGRTYANSCIARCNGVSIKSEGSCPTGILN

SEQ ID NO: 3831 - protein, 12 aa, synthetic construct
  REGION 1..12: note = Synthetic
FFGSYSGLGSSL

SEQ ID NO: 3832 - protein, 27 aa, synthetic construct
  REGION 1..27: note = Synthetic
EELGKIIEGFVTGAEDIISGASRITKS

SEQ ID NO: 3833 - protein, 14 aa, synthetic construct
  REGION 1..14: note = Synthetic
FEELGSKIAQLFTG

SEQ ID NO: 3834 - protein, 12 aa, synthetic construct
  REGION 1..12: note = Synthetic
EKIQAIVGQYVN

SEQ ID NO: 3835 - protein, 31 aa, synthetic construct
  REGION 1..31: note = Synthetic
REMSQIMQSARRLLNMCRVGPTECDFEMSTY

SEQ ID NO: 3836 - protein, 34 aa, synthetic construct
  REGION 1..34: note = Synthetic
LRKLETVVNEIVDEMNYLKRREAKLRDTNGKLIS

SEQ ID NO: 3837 - protein, 29 aa, synthetic construct
  REGION 1..29: note = Synthetic
DQFLSKIPAACNIKVGFPVSTNTNCETIH

SEQ ID NO: 3838 - protein, 29 aa, synthetic construct
  REGION 1..29: note = Synthetic
DQFLSKIPAACNIKVGFPVSTATNCETIH

SEQ ID NO: 3839 - protein, 33 aa, synthetic construct
  REGION 1..33: note = Synthetic
CGTDGKTYANECILCFENRKFGTSIRIQRRGLC

SEQ ID NO: 3840 - protein, 25 aa, synthetic construct
  REGION 1..25: note = Synthetic
LIGRCPSGWHNCRGSGPFIGYCCKQ

SEQ ID NO: 3841 - protein, 42 aa, synthetic construct
  REGION 1..42: note = Synthetic
CLKSAANSIKGIDTGKAAGLPGVCGVNIPYKISPSTDCSTVQ

SEQ ID NO: 3842 - protein, 16 aa, synthetic construct
  REGION 1..16: note = Synthetic
KFPELLQHVLSKAREG

SEQ ID NO: 3843 - protein, 22 aa, synthetic construct
  REGION 1..22: note = Synthetic
TVVEFLSRWITFCQSTIAAMTQ

SEQ ID NO: 3844 - protein, 17 aa, synthetic construct
  REGION 1..17: note = Synthetic
KDVNTLAEALLEADMMV

SEQ ID NO: 3845 - protein, 42 aa, synthetic construct
  REGION 1..42: note = Synthetic
ETLESLGGALEASLYSTEVVALSRLQASLQDMLWRLDLSPGC

SEQ ID NO: 3846 - protein, 25 aa, synthetic construct
  REGION 1..25: note = Synthetic
EKAEEWGRSGKDPDRFRPDGLPKKY

SEQ ID NO: 3847 - protein, 41 aa, synthetic construct
  REGION 1..41: note = Synthetic
KMFGDCWGDGDCCLHLGCKTRKLPPWTDKPYCAWDWTFGRK

SEQ ID NO: 3848 - protein, 24 aa, synthetic construct
  REGION 1..24: note = Synthetic
NMAAKCNACCGSRRGSCRGPQCIC

SEQ ID NO: 3849 - protein, 37 aa, synthetic construct
  REGION 1..37: note = Synthetic
ALERASEVLNNCLNSELHSRMIDYHIGLLKTMGSTTE

SEQ ID NO: 3850 - protein, 23 aa, synthetic construct
  REGION 1..23: note = Synthetic
LSFLKSLLGTFQKTEMQRQKSRP

SEQ ID NO: 3851 - protein, 19 aa, synthetic construct
  REGION 1..19: note = Synthetic
IDHLFENMKKALVLLKTEL

SEQ ID NO: 3852 - protein, 19 aa, synthetic construct
  REGION 1..19: note = Synthetic
IDHLFENMKKALVLLKTEL

SEQ ID NO: 3853 - protein, 17 aa, synthetic construct
  REGION 1..17: note = Synthetic
GYNAAYNRYFRQRRRAE

SEQ ID NO: 3854 - protein, 35 aa, synthetic construct
  REGION 1..35: note = Synthetic
SILDQILQNIGRSSGNIFHKEQQRTSAQRRSQGSQ

SEQ ID NO: 3855 - protein, 12 aa, synthetic construct
  REGION 1..12: note = Synthetic
FYGAYSGLGSSL

SEQ ID NO: 3856 - protein, 42 aa, synthetic construct
  REGION 1..42: note = Synthetic
ENYQKLIGRGAEDSKADQEANQWGRSGNDPNHFRPKGLPDKY

SEQ ID NO: 3857 - protein, 27 aa, synthetic construct
  REGION 1..27: note = Synthetic
HQMARKCDDCCGGKGRGKCYGPQCLCR

SEQ ID NO: 3858 - protein, 21 aa, synthetic construct
  REGION 1..21: note = Synthetic
IAKVENYLESLHLNRDKLKVC

SEQ ID NO: 3859 - protein, 42 aa, synthetic construct
  REGION 1..42: note = Synthetic
CLKSAANAIKGINYGKAAGLPGMCGVHIPYAISPSTNCNAVH

SEQ ID NO: 3860 - protein, 20 aa, synthetic construct
  REGION 1..20: note = Synthetic
SSLKSFVEKAAKELTTETTE

SEQ ID NO: 3861 - protein, 18 aa, synthetic construct
  REGION 1..18: note = Synthetic
CSRCCSYAGEAVQTQSGH

SEQ ID NO: 3862 - protein, 11 aa, synthetic construct
  REGION 1..11: note = Synthetic
LAALEKALKEY

SEQ ID NO: 3863 - protein, 15 aa, synthetic construct
  REGION 1..15: note = Synthetic
HVKQAINKMLTKISS

SEQ ID NO: 3864 - protein, 18 aa, synthetic construct
  REGION 1..18: note = Synthetic
GCLAGYMRTADGRCKPTF

SEQ ID NO: 3865 - protein, 26 aa, synthetic construct
  REGION 1..26: note = Synthetic
GALGIANSFLDEYLDLNIAKKLRRQF

SEQ ID NO: 3866 - protein, 13 aa, synthetic construct
  REGION 1..13: note = Synthetic
QYSRLGDKWARNK

SEQ ID NO: 3867 - protein, 18 aa, synthetic construct
  REGION 1..18: note = Synthetic
CSRCCSYAGEAVQTQSGH

SEQ ID NO: 3868 - protein, 24 aa, synthetic construct
  REGION 1..24: note = Synthetic
AVERCEDACDRFCTNEAQTVTVVS

SEQ ID NO: 3869 - protein, 34 aa, synthetic construct
  REGION 1..34: note = Synthetic
LKELVKKASDIIKKEESLEKKLTEHLSPGSSANG

SEQ ID NO: 3870 - protein, 35 aa, synthetic construct
  REGION 1..35: note = Synthetic
KPLHTMVNHISRFATKMTEPQPKYSTTEKQVLDML

SEQ ID NO: 3871 - protein, 26 aa, synthetic construct
  REGION 1..26: note = Synthetic
KRFLSTLLNVASNVVPTLICKITKKC

SEQ ID NO: 3872 - protein, 25 aa, synthetic construct
  REGION 1..25: note = Synthetic
WLAGCPSGWHNCKAHGPTIGWCCKQ

SEQ ID NO: 3873 - protein, 25 aa, synthetic construct
  REGION 1..25: note = Synthetic
WLAGCPSGWHNCKAHGPTIGWCCKQ

SEQ ID NO: 3874 - protein, 25 aa, synthetic construct
  REGION 1..25: note = Synthetic
WLAGCPSGWHNCKAHGPTIGWCCKQ

SEQ ID NO: 3875 - protein, 25 aa, synthetic construct
  REGION 1..25: note = Synthetic
WLAGCPSGWHNCKAHGPTIGWCCKQ

SEQ ID NO: 3876 - protein, 25 aa, synthetic construct
  REGION 1..25: note = Synthetic
WLAGCPSGWHNCKAHGPTIGWCCKK

SEQ ID NO: 3877 - protein, 14 aa, synthetic construct
  REGION 1..14: note = Synthetic
LLGTLGNLLNGLGL

SEQ ID NO: 3878 - protein, 31 aa, synthetic construct
  REGION 1..31: note = Synthetic
FAKCFHDLIKKFKKLGYVDGDNMVGASYDWR

SEQ ID NO: 3879 - protein, 35 aa, synthetic construct
  REGION 1..35: note = Synthetic
QIDTLYGAIIAGHLNPLESRPSSAIAPTSLLTPMP

SEQ ID NO: 3880 - protein, 19 aa, synthetic construct
  REGION 1..19: note = Synthetic
ELARQAMKQIQDVIDAAIE

SEQ ID NO: 3881 - protein, 19 aa, synthetic construct
  REGION 1..19: note = Synthetic
AEQMMEKIKNLWYTKVLGY

SEQ ID NO: 3882 - protein, 25 aa, synthetic construct
  REGION 1..25: note = Synthetic
WLAGCPSGWHNCKAHGPTIGWCCKK

SEQ ID NO: 3883 - protein, 17 aa, synthetic construct
  REGION 1..17: note = Synthetic
LPRLLRTYISRIYINKL

SEQ ID NO: 3884 - protein, 17 aa, synthetic construct
  REGION 1..17: note = Synthetic
LPRLLRTYISRIYINKL

SEQ ID NO: 3885 - protein, 30 aa, synthetic construct
  REGION 1..30: note = Synthetic
LRYIRGCAATCPETKPRDMVECCSTDRCNR

SEQ ID NO: 3886 - protein, 21 aa, synthetic construct
  REGION 1..21: note = Synthetic
GIVDQCCTSICSLYQLENYCN

SEQ ID NO: 3887 - protein, 21 aa, synthetic construct
  REGION 1..21: note = Synthetic
GIVDQCCTSICSLYQLENYCN

SEQ ID NO: 3888 - protein, 11 aa, synthetic construct
  REGION 1..11: note = Synthetic
SALGGLLKKIG

SEQ ID NO: 3889 - protein, 17 aa, synthetic construct
  REGION 1..17: note = Synthetic
VAKHVLASYNTAEATTN

SEQ ID NO: 3890 - protein, 20 aa, synthetic construct
  REGION 1..20: note = Synthetic
LRDLKGALESLIEEETGQKT

SEQ ID NO: 3891 - protein, 17 aa, synthetic construct
  REGION 1..17: note = Synthetic
VAQILQDFAEDIDKMKH

SEQ ID NO: 3892 - protein, 30 aa, synthetic construct
  REGION 1..30: note = Synthetic
VYTVVASFVSLFIFGFLSNDPGRRPGRKRI

SEQ ID NO: 3893 - protein, 16 aa, synthetic construct
  REGION 1..16: note = Synthetic
SNCQHFAEELYQFVQA

SEQ ID NO: 3894 - protein, 22 aa, synthetic construct
  REGION 1..22: note = Synthetic
DNVAAAWNKALDNTFAIVVPRL

SEQ ID NO: 3895 - protein, 22 aa, synthetic construct
  REGION 1..22: note = Synthetic
DNVAAAWNKALDNTFAIVVPRL

SEQ ID NO: 3896 - protein, 36 aa, synthetic construct
  REGION 1..36: note = Synthetic
ECDKAAATCFARNKTTYNKKYQYYSNKHCRGSTPRC

SEQ ID NO: 3897 - protein, 14 aa, synthetic construct
  REGION 1..14: note = Synthetic
FVYDVETVMSKLVK

SEQ ID NO: 3898 - protein, 23 aa, synthetic construct
  REGION 1..23: note = Synthetic
SRILNYMEDVLHYIGISPIYRGS

SEQ ID NO: 3899 - protein, 20 aa, synthetic construct
  REGION 1..20: note = Synthetic
VLNNLAKGLDDILNKVLGQQ

SEQ ID NO: 3900 - protein, 16 aa, synthetic construct
  REGION 1..16: note = Synthetic
KFIKPMEYVLNSVEDH

SEQ ID NO: 3901 - protein, 21 aa, synthetic construct
  REGION 1..21: note = Synthetic
LRDLRGALERLIEEEAGQKKM

SEQ ID NO: 3902 - protein, 24 aa, synthetic construct
  REGION 1..24: note = Synthetic
QAYQRYFGSGTHPQQRPAAAARRY

SEQ ID NO: 3903 - protein, 25 aa, synthetic construct
  REGION 1..25: note = Synthetic
AATIVEFLNKWIIFCQSIISKRLDN

SEQ ID NO: 3904 - protein, 21 aa, synthetic construct
  REGION 1..21: note = Synthetic
FARQFFQQWYYVMEQLVAHNH

SEQ ID NO: 3905 - protein, 21 aa, synthetic construct
  REGION 1..21: note = Synthetic
FARQFFQQWYYVMEQLVAHNH

SEQ ID NO: 3906 - protein, 42 aa, synthetic construct
  REGION 1..42: note = Synthetic
EPMREYMHHLLALEHRAEEQFLEHWLNPHCKPHCDRNIVHPV

SEQ ID NO: 3907 - protein, 22 aa, synthetic construct
  REGION 1..22: note = Synthetic
DNVAAAWNKALDNTFAIVVPRL

SEQ ID NO: 3908 - protein, 16 aa, synthetic construct
  REGION 1..16: note = Synthetic
KVGKQLASHLAKKQLE

SEQ ID NO: 3909 - protein, 32 aa, synthetic construct
  REGION 1..32: note = Synthetic
EALEKFDKALKALPMHIRLSFNPTQLEEQCHV

SEQ ID NO: 3910 - protein, 32 aa, synthetic construct
  REGION 1..32: note = Synthetic
EALEKFDKALKALPMHIRLSFNPTQLEEQCHI

SEQ ID NO: 3911 - protein, 42 aa, synthetic construct
  REGION 1..42: note = Synthetic
EPMREYMHHLLALEHRAEEQFLEHWLNPHCKPHCDRNIVQPV

SEQ ID NO: 3912 - protein, 18 aa, synthetic construct
  REGION 1..18: note = Synthetic
CSRCCSYAGEAVQTQPGH

SEQ ID NO: 3913 - protein, 12 aa, synthetic construct
  REGION 1..12: note = Synthetic
FYGSYSGLGSSL

SEQ ID NO: 3914 - protein, 12 aa, synthetic construct
  REGION 1..12: note = Synthetic
FYGSYSGLGSSL

SEQ ID NO: 3915 - protein, 12 aa, synthetic construct
  REGION 1..12: note = Synthetic
FYGSYSGLGSSL

SEQ ID NO: 3916 - protein, 12 aa, synthetic construct
  REGION 1..12: note = Synthetic
FYGSYSGLGSSL

SEQ ID NO: 3917 - protein, 12 aa, synthetic construct
  REGION 1..12: note = Synthetic
FYGSYSGLGSSL

SEQ ID NO: 3918 - protein, 12 aa, synthetic construct
  REGION 1..12: note = Synthetic
FYGSYSGLGSSL

SEQ ID NO: 3919 - protein, 12 aa, synthetic construct
  REGION 1..12: note = Synthetic
FYGSYSGLGSSL

SEQ ID NO: 3920 - protein, 12 aa, synthetic construct
  REGION 1..12: note = Synthetic
FYGSYSGLGSSL

SEQ ID NO: 3921 - protein, 12 aa, synthetic construct
  REGION 1..12: note = Synthetic
FYGSYSGLGSSL

SEQ ID NO: 3922 - protein, 12 aa, synthetic construct
  REGION 1..12: note = Synthetic
FYGSYSGLGSSL

SEQ ID NO: 3923 - protein, 12 aa, synthetic construct
  REGION 1..12: note = Synthetic
FYGSYSGLGSSL

SEQ ID NO: 3924 - protein, 12 aa, synthetic construct
  REGION 1..12: note = Synthetic
FYGSYSGLGSSL

SEQ ID NO: 3925 - protein, 12 aa, synthetic construct
  REGION 1..12: note = Synthetic
FYGSYSGLGSSL

SEQ ID NO: 3926 - protein, 12 aa, synthetic construct
  REGION 1..12: note = Synthetic
FYGSYSGLGSSL

SEQ ID NO: 3927 - protein, 12 aa, synthetic construct
  REGION 1..12: note = Synthetic
FYGSYSGLGSSL

SEQ ID NO: 3928 - protein, 12 aa, synthetic construct
  REGION 1..12: note = Synthetic
FYGSYSGLGSSL

SEQ ID NO: 3929 - protein, 12 aa, synthetic construct
  REGION 1..12: note = Synthetic
FYGSYSGLGSSL

SEQ ID NO: 3930 - protein, 12 aa, synthetic construct
  REGION 1..12: note = Synthetic
FYGSYSGLGSSL

SEQ ID NO: 3931 - protein, 12 aa, synthetic construct
  REGION 1..12: note = Synthetic
FYGSYSGLGSSL

SEQ ID NO: 3932 - protein, 12 aa, synthetic construct
  REGION 1..12: note = Synthetic
FYGSYSGLGSSL

SEQ ID NO: 3933 - protein, 12 aa, synthetic construct
  REGION 1..12: note = Synthetic
FYGSYSGLGSSL

SEQ ID NO: 3934 - protein, 12 aa, synthetic construct
  REGION 1..12: note = Synthetic
FYGSYSGLGSSL

SEQ ID NO: 3935 - protein, 12 aa, synthetic construct
  REGION 1..12: note = Synthetic
FYGSYSGLGSSL

SEQ ID NO: 3936 - protein, 12 aa, synthetic construct
  REGION 1..12: note = Synthetic
FYGSYSGLGSSL

SEQ ID NO: 3937 - protein, 12 aa, synthetic construct
  REGION 1..12: note = Synthetic
FYGSYSGLGSSL

SEQ ID NO: 3938 - protein, 12 aa, synthetic construct
  REGION 1..12: note = Synthetic
FYGSYSGLGSSL

SEQ ID NO: 3939 - protein, 12 aa, synthetic construct
  REGION 1..12: note = Synthetic
FYGSYSGLGSSL

SEQ ID NO: 3940 - protein, 12 aa, synthetic construct
  REGION 1..12: note = Synthetic
FYGSYSGLGSSL

SEQ ID NO: 3941 - protein, 12 aa, synthetic construct
  REGION 1..12: note = Synthetic
FYGSYSGLGSSL

SEQ ID NO: 3942 - protein, 12 aa, synthetic construct
  REGION 1..12: note = Synthetic
FYGSYSGLGSSL

SEQ ID NO: 3943 - protein, 12 aa, synthetic construct
  REGION 1..12: note = Synthetic
FYGSYSGLGSSL

SEQ ID NO: 3944 - protein, 12 aa, synthetic construct
  REGION 1..12: note = Synthetic
FYGSYSGLGSSL

SEQ ID NO: 3945 - protein, 12 aa, synthetic construct
  REGION 1..12: note = Synthetic
FYGSYSGLGSSL

SEQ ID NO: 3946 - protein, 12 aa, synthetic construct
  REGION 1..12: note = Synthetic
FYGSYSGLGSSL

SEQ ID NO: 3947 - protein, 12 aa, synthetic construct
  REGION 1..12: note = Synthetic
FYGSYSGLGSSL

SEQ ID NO: 3948 - protein, 12 aa, synthetic construct
  REGION 1..12: note = Synthetic
FYGSYSGLGSSL

SEQ ID NO: 3949 - protein, 12 aa, synthetic construct
  REGION 1..12: note = Synthetic
FYGSYSGLGSSL

SEQ ID NO: 3950 - protein, 12 aa, synthetic construct
  REGION 1..12: note = Synthetic
FYGSYSGLGSSL

SEQ ID NO: 3951 - protein, 12 aa, synthetic construct
  REGION 1..12: note = Synthetic
FYGSYSGLGSSL

SEQ ID NO: 3952 - protein, 12 aa, synthetic construct
  REGION 1..12: note = Synthetic
FYGSYSGLGSSL

SEQ ID NO: 3953 - protein, 12 aa, synthetic construct
  REGION 1..12: note = Synthetic
FYGSYSGLGSSL

SEQ ID NO: 3954 - protein, 12 aa, synthetic construct
  REGION 1..12: note = Synthetic
FYGSYSGLGSSL

SEQ ID NO: 3955 - protein, 12 aa, synthetic construct
  REGION 1..12: note = Synthetic
FYGSYSGLGSSL

SEQ ID NO: 3956 - protein, 12 aa, synthetic construct
  REGION 1..12: note = Synthetic
FYGSYSGLGSSL

SEQ ID NO: 3957 - protein, 12 aa, synthetic construct
  REGION 1..12: note = Synthetic
FYGSYSGLGSSL

SEQ ID NO: 3958 - protein, 12 aa, synthetic construct
  REGION 1..12: note = Synthetic
FYGSYSGLGSSL

SEQ ID NO: 3959 - protein, 12 aa, synthetic construct
  REGION 1..12: note = Synthetic
FYGSYSGLGSSL

SEQ ID NO: 3960 - protein, 12 aa, synthetic construct
  REGION 1..12: note = Synthetic
FYGSYSGLGSSL

SEQ ID NO: 3961 - protein, 12 aa, synthetic construct
  REGION 1..12: note = Synthetic
FYGSYSGLGSSL

SEQ ID NO: 3962 - protein, 12 aa, synthetic construct
  REGION 1..12: note = Synthetic
FYGSYSGLGSSL

SEQ ID NO: 3963 - protein, 12 aa, synthetic construct
  REGION 1..12: note = Synthetic
FYGSYSGLGSSL

SEQ ID NO: 3964 - protein, 12 aa, synthetic construct
  REGION 1..12: note = Synthetic
FYGSYSGLGSSL

SEQ ID NO: 3965 - protein, 12 aa, synthetic construct
  REGION 1..12: note = Synthetic
FYGSYSGLGSSL

SEQ ID NO: 3966 - protein, 12 aa, synthetic construct
  REGION 1..12: note = Synthetic
FYGSYSGLGSSL

SEQ ID NO: 3967 - protein, 12 aa, synthetic construct
  REGION 1..12: note = Synthetic
FYGSYSGLGSSL

SEQ ID NO: 3968 - protein, 12 aa, synthetic construct
  REGION 1..12: note = Synthetic
FYGSYSGLGSSL

SEQ ID NO: 3969 - protein, 12 aa, synthetic construct
  REGION 1..12: note = Synthetic
FYGSYSGLGSSL

SEQ ID NO: 3970 - protein, 12 aa, synthetic construct
  REGION 1..12: note = Synthetic
FYGSYSGLGSSL

SEQ ID NO: 3971 - protein, 12 aa, synthetic construct
  REGION 1..12: note = Synthetic
FYGSYSGLGSSL

SEQ ID NO: 3972 - protein, 12 aa, synthetic construct
  REGION 1..12: note = Synthetic
FYGSYSGLGSSL

SEQ ID NO: 3973 - protein, 12 aa, synthetic construct
  REGION 1..12: note = Synthetic
FYGSYSGLGSSL

SEQ ID NO: 3974 - protein, 12 aa, synthetic construct
  REGION 1..12: note = Synthetic
FYGSYSGLGSSL

SEQ ID NO: 3975 - protein, 12 aa, synthetic construct
  REGION 1..12: note = Synthetic
FYGSYSGLGSSL

SEQ ID NO: 3976 - protein, 12 aa, synthetic construct
  REGION 1..12: note = Synthetic
FYGSYSGLGSSL

SEQ ID NO: 3977 - protein, 12 aa, synthetic construct
  REGION 1..12: note = Synthetic
FYGSYSGLGSSL

SEQ ID NO: 3978 - protein, 12 aa, synthetic construct
  REGION 1..12: note = Synthetic
FYGSYSGLGSSL

SEQ ID NO: 3979 - protein, 12 aa, synthetic construct
  REGION 1..12: note = Synthetic
FYGSYSGLGSSL

SEQ ID NO: 3980 - protein, 12 aa, synthetic construct
  REGION 1..12: note = Synthetic
FYGSYSGLGSSL

SEQ ID NO: 3981 - protein, 12 aa, synthetic construct
  REGION 1..12: note = Synthetic
FYGSYSGLGSSL

SEQ ID NO: 3982 - protein, 12 aa, synthetic construct
  REGION 1..12: note = Synthetic
FYGSYSGLGSSL

SEQ ID NO: 3983 - protein, 12 aa, synthetic construct
  REGION 1..12: note = Synthetic
FYGSYSGLGSSL

SEQ ID NO: 3984 - protein, 12 aa, synthetic construct
  REGION 1..12: note = Synthetic
FYGSYSGLGSSL

SEQ ID NO: 3985 - protein, 12 aa, synthetic construct
  REGION 1..12: note = Synthetic
FYGSYSGLGSSL

SEQ ID NO: 3986 - protein, 12 aa, synthetic construct
  REGION 1..12: note = Synthetic
FYGSYSGLGSSL

SEQ ID NO: 3987 - protein, 12 aa, synthetic construct
  REGION 1..12: note = Synthetic
FYGSYSGLGSSL

SEQ ID NO: 3988 - protein, 12 aa, synthetic construct
  REGION 1..12: note = Synthetic
FYGSYSGLGSSL

SEQ ID NO: 3989 - protein, 12 aa, synthetic construct
  REGION 1..12: note = Synthetic
FYGSYSGLGSSL

SEQ ID NO: 3990 - protein, 12 aa, synthetic construct
  REGION 1..12: note = Synthetic
FYGSYSGLGSSL

SEQ ID NO: 3991 - protein, 12 aa, synthetic construct
  REGION 1..12: note = Synthetic
FYGSYSGLGSSL

SEQ ID NO: 3992 - protein, 12 aa, synthetic construct
  REGION 1..12: note = Synthetic
FYGSYSGLGSSL

SEQ ID NO: 3993 - protein, 12 aa, synthetic construct
  REGION 1..12: note = Synthetic
FYGSYSGLGSSL

SEQ ID NO: 3994 - protein, 24 aa, synthetic construct
  REGION 1..24: note = Synthetic
KYLTSLGSNFGGIFVYPLFLLSTF

SEQ ID NO: 3995 - protein, 38 aa, synthetic construct
  REGION 1..38: note = Synthetic
RGCGGLMAGCDGKSTFCCSGYNCSPTWKWCVYARPGRR

SEQ ID NO: 3996 - protein, 38 aa, synthetic construct; identical to SEQ ID NO: 3995
  REGION 1..38: note = Synthetic

SEQ ID NO: 3997 - protein, 23 aa, synthetic construct
  REGION 1..23: note = Synthetic
SLQNCVETCVHGLRRNQDLYVNE

SEQ ID NO: 3998 - protein, 12 aa, synthetic construct
  REGION 1..12: note = Synthetic
FQEAYRRFYGPV

SEQ ID NO: 3999 - protein, 12 aa, synthetic construct
  REGION 1..12: note = Synthetic
FQEAYRRFYGPV

SEQ ID NO: 4000 - protein, 18 aa, synthetic construct
  REGION 1..18: note = Synthetic
QAMSGCTELVKQLLQSDE

SEQ ID NO: 4001 - protein, 12 aa, synthetic construct
  REGION 1..12: note = Synthetic
FYGSYSGLGSSL

SEQ ID NO: 4002 - protein, 17 aa, synthetic construct
  REGION 1..17: note = Synthetic
LIDVLDEYISGVQTVGK

SEQ ID NO: 4003 - protein, 17 aa, synthetic construct
  REGION 1..17: note = Synthetic
LIDVLDEYISGVQTVGK

SEQ ID NO: 4004 - protein, 26 aa, synthetic construct
  REGION 1..26: note = Synthetic
SNFKDLVDSLLQVLNMKEGTPQLNQQ

SEQ ID NO: 4005 - protein, 30 aa, synthetic construct
  REGION 1..30: note = Synthetic
LTDVVRGCAKTCPTPIEEEEVYCCLKDNCN

SEQ ID NO: 4006 - protein, 39 aa, synthetic construct
  REGION 1..39: note = Synthetic
DWVNDGLSSLKDYWGKLKGKFSSFWDSTFEDTTPSPAVA

SEQ ID NO: 4007 - protein, 32 aa, synthetic construct
  REGION 1..32: note = Synthetic
RGMWGKCKDGLTTCLAPSECCSGNCEQNCKMW

SEQ ID NO: 4008 - protein, 32 aa, synthetic construct; identical to SEQ ID NO: 4007
  REGION 1..32: note = Synthetic

SEQ ID NO: 4009 - protein, 31 aa, synthetic construct
  REGION 1..31: note = Synthetic
DDLVDALTKLARGLKAQTSPEQLCGLLKICK

SEQ ID NO: 4010 - protein, 14 aa, synthetic construct
  REGION 1..14: note = Synthetic
FEELGSKIAQLFTG

SEQ ID NO: 4011 - protein, 14 aa, synthetic construct
  REGION 1..14: note = Synthetic
FEELGSKIAQLFTG

SEQ ID NO: 4012 - protein, 14 aa, synthetic construct
  REGION 1..14: note = Synthetic
FEELGSKIAQLFTG

SEQ ID NO: 4013 - protein, 41 aa, synthetic construct
  REGION 1..41: note = Synthetic
DYYGDLAAHLGYFPSSIVREDLTLKPGKVDMKTDEWDFYCQ

SEQ ID NO: 4014 - protein, 41 aa, synthetic construct
  REGION 1..41: note = Synthetic
ARGSDVGDDIKEKFKKLVLEQNFPEAHIKYFNAEQCTPTAA

SEQ ID NO: 4015 - protein, 18 aa, synthetic construct
  REGION 1..18: note = Synthetic
GSSAGAKCMNGKCKCYNN

SEQ ID NO: 4016 - protein, 18 aa, synthetic construct
  REGION 1..18: note = Synthetic
NISYVLREIMKHVDDNNK

SEQ ID NO: 4017 - protein, 17 aa, synthetic construct
  REGION 1..17: note = Synthetic
LIDELRSLGQGIQGQQY

SEQ ID NO: 4018 - protein, 17 aa, synthetic construct
  REGION 1..17: note = Synthetic
LIDELRSLGQGIQGQQY

SEQ ID NO: 4019 - protein, 38 aa, synthetic construct
  REGION 1..38: note = Synthetic
HCAKRIVSGARGMNNWVEWRLHCSGRPLFYWLTGCRLR

SEQ ID NO: 4020 - protein, 20 aa, synthetic construct
  REGION 1..20: note = Synthetic
LFKTLLSAVGSALSSSGDQE

SEQ ID NO: 4021 - protein, 28 aa, synthetic construct
  REGION 1..28: note = Synthetic
EAMKEAVERCNNACSEVCTKGSYAVVNA

SEQ ID NO: 4022 - protein, 26 aa, synthetic construct
  REGION 1..26: note = Synthetic
VSWGDNVAAAWNKALDNTMAVAVAHL

SEQ ID NO: 4023 - protein, 26 aa, synthetic construct
  REGION 1..26: note = Synthetic
VSWGDNVAAAWNKALDNTMAVAVAHL

SEQ ID NO: 4024 - protein, 27 aa, synthetic construct
  REGION 1..27: note = Synthetic
KSFSEAIDKLSNVLEPNKKNENKEQQA

SEQ ID NO: 4025 - protein, 25 aa, synthetic construct
  REGION 1..25: note = Synthetic
GLLSSLSSVAKHVLPHVVPVIAEHL

SEQ ID NO: 4026 - protein, 25 aa, synthetic construct
  REGION 1..25: note = Synthetic
GLLSSLSSVAKHVLPHVVPVIAEHL

SEQ ID NO: 4027 - protein, 35 aa, synthetic construct
  REGION 1..35: note = Synthetic
EASSCCSSCFSRASSPATPLLTPLRNSRSPSMVAF

SEQ ID NO: 4028 - protein, 24 aa, synthetic construct
  REGION 1..24: note = Synthetic
IYGGCGGNANNFKTIEECKSTCAA

SEQ ID NO: 4029 - protein, 27 aa, synthetic construct
  REGION 1..27: note = Synthetic
KECWAPCKAAFGVDRGKCMGKKCKCYV

SEQ ID NO: 4030 - protein, 41 aa, synthetic construct; identical to SEQ ID NO: 3789
  REGION 1..41: note = Synthetic

SEQ ID NO: 4031 - protein, 29 aa, synthetic construct
  REGION 1..29: note = Synthetic
EEANDAVESCDQACSSFCNVHVGAATVVA

SEQ ID NO: 4032 - protein, 20 aa, synthetic construct
  REGION 1..20: note = Synthetic
LFKTLLSAVGSALSSSGEQE

SEQ ID NO: 4033 - protein, 20 aa, synthetic construct
  REGION 1..20: note = Synthetic
LFKTLLSAVGSALSSSGEQE

SEQ ID NO: 4034 - protein, 15 aa, synthetic construct
  REGION 1..15: note = Synthetic
CGDAHHFYRGCTCTC

SEQ ID NO: 4035 - protein, 42 aa, synthetic construct
  REGION 1..42: note = Synthetic
AVEEVKSAFSKLQERGVYKAMGEFDIFINYIEAYMTMKMRKN

SEQ ID NO: 4036 - protein, 17 aa, synthetic construct
  REGION 1..17: note = Synthetic
LESVLRKLLDQAKAITQ

SEQ ID NO: 4037 - protein, 14 aa, synthetic construct
  REGION 1..14: note = Synthetic
FEELGSKLAQLFTG

SEQ ID NO: 4038 - protein, 29 aa, synthetic construct
  REGION 1..29: note = Synthetic
EEANDAVESCDQACSSFCSVHVGSATVVA

SEQ ID NO: 4039 - protein, 29 aa, synthetic construct
  REGION 1..29: note = Synthetic
EEANDAVESCDQACSSFCSVHVGSATVVA

SEQ ID NO: 4040 - protein, 20 aa, synthetic construct
  REGION 1..20: note = Synthetic
AVEFLNKWITFCQSIYSTLT

SEQ ID NO: 4041 - protein, 23 aa, synthetic construct
  REGION 1..23: note = Synthetic
HAFEFMQRALQDLKKTVYNLDTR

SEQ ID NO: 4042 - protein, 33 aa, synthetic construct
  REGION 1..33: note = Synthetic
EEVMEKFSRALQPLPGRVQIVQDPSGGQERCGF

SEQ ID NO: 4043 - protein, 23 aa, synthetic construct
  REGION 1..23: note = Synthetic
CNEGWEKCTAVYTPVASCCRKKK

SEQ ID NO: 4044 - protein, 27 aa, synthetic construct
  REGION 1..27: note = Synthetic
VEALSHVLEKLVEILRNDDPDINTFSK

SEQ ID NO: 4045 - protein, 34 aa, synthetic construct
  REGION 1..34: note = Synthetic
GDLERAAASLPAFCNVDIPNGGGGVCYWLARSGY

SEQ ID NO: 4046 - protein, 23 aa, synthetic construct
  REGION 1..23: note = Synthetic
NNLYSCISQWQRCFNNCESNNQY

SEQ ID NO: 4047 - protein, 35 aa, synthetic construct
  REGION 1..35: note = Synthetic
SLGSFIASLFAGAFIALAIGGVLVFISQSDRVTRS

SEQ ID NO: 4048 - protein, 11 aa, synthetic construct
  REGION 1..11: note = Synthetic
VAMIEAVIEKY

SEQ ID NO: 4049 - protein, 18 aa, synthetic construct
  REGION 1..18: note = Synthetic
LRELVSNAADACDKRRFL

SEQ ID NO: 4050 - protein, 13 aa, synthetic construct
  REGION 1..13: note = Synthetic
HAINAVSAIAKHN

SEQ ID NO: 4051 - protein, 20 aa, synthetic construct
  REGION 1..20: note = Synthetic
RCCSGGCSSGKCVNGACDCS

SEQ ID NO: 4052 - protein, 32 aa, synthetic construct
  REGION 1..32: note = Synthetic
FSTMLQEAIESFKEALKQKVDFIDAYKSLGQA

SEQ ID NO: 4053 - protein, 21 aa, synthetic construct
  REGION 1..21: note = Synthetic
GIVDQCCTNICSRNQLLTYCN

SEQ ID NO: 4054 - protein, 16 aa, synthetic construct
  REGION 1..16: note = Synthetic
VLGLVGNALGGLIKNE

SEQ ID NO: 4055 - protein, 23 aa, synthetic construct
  REGION 1..23: note = Synthetic
LADTMMKIFQQLMDRTKALPAPQ

SEQ ID NO: 4056 - protein, 27 aa, synthetic construct
  REGION 1..27: note = Synthetic
DAEQAWNQAFDCIYEVIFSNLDGHPVV

SEQ ID NO: 4057 - protein, 16 aa, synthetic construct
  REGION 1..16: note = Synthetic
VLSLVGNALGGLLKNE

SEQ ID NO: 4058 - protein, 13 aa, synthetic construct
  REGION 1..13: note = Synthetic
KRLTKMGGDLNSP

SEQ ID NO: 4059 - protein, 26 aa, synthetic construct
  REGION 1..26: note = Synthetic
LNAYFEAYQAIFPFLLEAFLRKEQKV

SEQ ID NO: 4060 - protein, 42 aa, synthetic construct
  REGION 1..42: note = Synthetic
NGCADTCESYARMHNGGPNGCKSSHHHATDNYWRLVQAKGCS

SEQ ID NO: 4061 - protein, 12 aa, synthetic construct
  REGION 1..12: note = Synthetic
GIPKVMNDAGRR

SEQ ID NO: 4062 - protein, 25 aa, synthetic construct
  REGION 1..25: note = Synthetic
LIGRCPSGWHNCRGSGPFIGYCCKQ

SEQ ID NO: 4063 - protein, 28 aa, synthetic construct
  REGION 1..28: note = Synthetic
ASSIFKTLRTIANDDCELCVNVACTGCL

SEQ ID NO: 4064 - protein, 28 aa, synthetic construct
  REGION 1..28: note = Synthetic
CYTGYNGVGKCIASKASRTPNCVCTYNC

SEQ ID NO: 4065 - protein, 33 aa, synthetic construct
  REGION 1..33: note = Synthetic
FSSLKDYWSTVKDKLSGFWDLNPEAKPTLAEAA

SEQ ID NO: 4066 - protein, 32 aa, synthetic construct
  REGION 1..32: note = Synthetic
VRQMYRVASNIPSMCNLQPMSCLFRQQQSSWL

SEQ ID NO: 4067 - protein, 33 aa, synthetic construct
  REGION 1..33: note = Synthetic
IYGGCGGNANNFHTLEECEKVCGVRSRDSPKEN

SEQ ID NO: 4068 - protein, 11 aa, synthetic construct
  REGION 1..11: note = Synthetic
VAMIEAVIEKY

SEQ ID NO: 4069 - protein, 24 aa, synthetic construct
  REGION 1..24: note = Synthetic
IYGGCYGNANNFKTIDECKRTCAA

SEQ ID NO: 4070 - protein, 18 aa, synthetic construct
  REGION 1..18: note = Synthetic
AAWGATLDTFFGMIFSKM

SEQ ID NO: 4071 - protein, 12 aa, synthetic construct
  REGION 1..12: note = Synthetic
VLNSLDNLVSGL

SEQ ID NO: 4072 - protein, 12 aa, synthetic construct
  REGION 1..12: note = Synthetic
VLNSLDNLVSGL

SEQ ID NO: 4073 - protein, 32 aa, synthetic construct
  REGION 1..32: note = Synthetic
NVNEIFYDLVRQINRKTPVPGKARKKSTCHLL

SEQ ID NO: 4074 - protein, 40 aa, synthetic construct
  REGION 1..40: note = Synthetic
LSSIGQCGEDWVVKGCAKTCPTAGPGERVKCCYSPRCNKN

SEQ ID NO: 4075 - protein, 34 aa, synthetic construct
  REGION 1..34: note = Synthetic
DDLNKWAYKAYKCATSGRFGHWVNEYMKQEMETK

SEQ ID NO: 4076 - protein, 18 aa, synthetic construct
  REGION 1..18: note = Synthetic
GAGKGVLTTLSCKLDKSC

SEQ ID NO: 4077 - protein, 21 aa, synthetic construct
  REGION 1..21: note = Synthetic
GEAFAAALDGFRRLPYRLSSE

SEQ ID NO: 4078 - protein, 21 aa, synthetic construct
  REGION 1..21: note = Synthetic
DSIFSKMYNCWRKCALGDEKK

SEQ ID NO: 4079 - protein, 28 aa, synthetic construct
  REGION 1..28: note = Synthetic
NILRLFQEIINSITEKNLSFSPFVSLHI

SEQ ID NO: 4080 - protein, 37 aa, synthetic construct
  REGION 1..37: note = Synthetic
IAAVVDVIRELGICPDDAAVIPIKSNRFYTTETLKVE

SEQ ID NO: 4081 - protein, 34 aa, synthetic construct
  REGION 1..34: note = Synthetic
MTEYMNFVEEMGIEDENVQRVMDTDTCPNKIRIR

SEQ ID NO: 4082 - protein, 42 aa, synthetic construct
  REGION 1..42: note = Synthetic
LQNAGTQLKRLVDTLPQETRINIMKLTEKILTSPLCKQDLRF

SEQ ID NO: 4083 - protein, 17 aa, synthetic construct
  REGION 1..17: note = Synthetic
AAKEFVSWLKTGRGRRD

SEQ ID NO: 4084 - protein, 33 aa, synthetic construct
  REGION 1..33: note = Synthetic
NEVMEKFDRALKTLPVHMRIVLDLSQGKGELGP

SEQ ID NO: 4085 - protein, 30 aa, synthetic construct
  REGION 1..30: note = Synthetic
LTVLDGAAGDLLLRLMHLANRQQQGKQPGL

SEQ ID NO: 4086 - protein, 18 aa, synthetic construct
  REGION 1..18: note = Synthetic
DVFQCINNICKCVSHHRT

SEQ ID NO: 4087 - protein, 20 aa, synthetic construct
  REGION 1..20: note = Synthetic
SDLVSSAQRFIYNLQSIYST

SEQ ID NO: 4088 - protein, 20 aa, synthetic construct
  REGION 1..20: note = Synthetic
LAEQLMEKIKSLWYTKVLGY

SEQ ID NO: 4089 - protein, 22 aa, synthetic construct
  REGION 1..22: note = Synthetic
SDAISYVTKLASNALAFINHLF

SEQ ID NO: 4090 - protein, 22 aa, synthetic construct
  REGION 1..22: note = Synthetic
SDAISYVTKLASNALAFINHLY

SEQ ID NO: 4091 - protein, 30 aa, synthetic construct
  REGION 1..30: note = Synthetic
GKRGMGAWPSWTLNCQHSDTLARWLDGCKL

SEQ ID NO: 4092 - protein, 18 aa, synthetic construct
  REGION 1..18: note = Synthetic
LSSVIRNVFKICSENIFV

SEQ ID NO: 4093 - protein, 28 aa, synthetic construct
  REGION 1..28: note = Synthetic
DKAEHAWHDAMDKMYFVIFSSLDGHPVQ

SEQ ID NO: 4094 - protein, 12 aa, synthetic construct
  REGION 1..12: note = Synthetic
FQEAYRRFYGIA

SEQ ID NO: 4095 - protein, 24 aa, synthetic construct
  REGION 1..24: note = Synthetic
VLDWFGQGLNAMGNAISRYYCDAE

SEQ ID NO: 4096 - protein, 19 aa, synthetic construct
  REGION 1..19: note = Synthetic
KWVEEAIAYLDMKTPTPKP

SEQ ID NO: 4097 - protein, 26 aa, synthetic construct
  REGION 1..26: note = Synthetic
DAVQSACKYVRQAAVAARATQALIKK

SEQ ID NO: 4098 - protein, 12 aa, synthetic construct
  REGION 1..12: note = Synthetic
GIPKVMNDAGRR

SEQ ID NO: 4099 - protein, 21 aa, synthetic construct
  REGION 1..21: note = Synthetic
RTLWKIWDYICEVLTWIWGED

SEQ ID NO: 4100 - protein, 42 aa, synthetic construct
  REGION 1..42: note = Synthetic
ACKCIKSAAGGLNAGKAAGIPSMCGVSVPYAISASVDCSKIR

SEQ ID NO: 4101 - protein, 42 aa, synthetic construct; identical to SEQ ID NO: 4100
  REGION 1..42: note = Synthetic

SEQ ID NO: 4102 - protein, 42 aa, synthetic construct; identical to SEQ ID NO: 4100
  REGION 1..42: note = Synthetic

SEQ ID NO: 4103 - protein, 28 aa, synthetic construct
  REGION 1..28: note = Synthetic
RDYYGSVPSYCNRIGTPIAECACSLTPC

SEQ ID NO: 4104 - protein, 23 aa, synthetic construct
  REGION 1..23: note = Synthetic
GQALGKFLQEVLWEDTNEALADE

SEQ ID NO: 4105 - protein, 11 aa, synthetic construct
  REGION 1..11: note = Synthetic
EWIQKGLEWVE

SEQ ID NO: 4106 - protein, 21 aa, synthetic construct
  REGION 1..21: note = Synthetic
RAFDCLGQCGRCDFHKLQCVH

SEQ ID NO: 4107 - protein, 21 aa, synthetic construct
  REGION 1..21: note = Synthetic
CDSARKCCEGLVCRLWCKKII

SEQ ID NO: 4108 - protein, 29 aa, synthetic construct
  REGION 1..29: note = Synthetic
DDVAKDVEEVVDEIVDEVADAVEDAEKTE

SEQ ID NO: 4109 - protein, 21 aa, synthetic construct
  REGION 1..21: note = Synthetic
ALQKYLASILGSRTSPPPPSR

SEQ ID NO: 4110 - protein, 21 aa, synthetic construct
  REGION 1..21: note = Synthetic
ALQKYLASILGSRTSPPPPSR

SEQ ID NO: 4111 - protein, 14 aa, synthetic construct
  REGION 1..14: note = Synthetic
FWHCVDSVCKCFFF

SEQ ID NO: 4112 - protein, 22 aa, synthetic construct
  REGION 1..22: note = Synthetic
CNEGWEKCASYYSPIAECCRKK

SEQ ID NO: 4113 - protein, 35 aa, synthetic construct
  REGION 1..35: note = Synthetic
TAFSSVTHICRDVNYGWIIRYMHANGASMFFICLF

SEQ ID NO: 4114 - protein, 28 aa, synthetic construct
  REGION 1..28: note = Synthetic
TAFSSVTHICRDVNYGWIIRYMHANGAS

SEQ ID NO: 4115 - protein, 28 aa, synthetic construct
  REGION 1..28: note = Synthetic
TAFSSVTHICRDVNYGWIIRYMHANGAS

SEQ ID NO: 4116 - protein, 27 aa, synthetic construct
  REGION 1..27: note = Synthetic
DAEQAWNQAFDCIYEVIFSNLDGHPVV

SEQ ID NO: 4117 - protein, 11 aa, synthetic construct
  REGION 1..11: note = Synthetic
IGALFARGGNL

SEQ ID NO: 4118 - protein, 42 aa, synthetic construct
  REGION 1..42: note = Synthetic
CLKSAANAIKGIDMGKAAGLPGACGVNIPYKISPSTDCSKVQ

SEQ ID NO: 4119 - protein, 13 aa, synthetic construct
  REGION 1..13: note = Synthetic
ERLRKMGGDLNSP

SEQ ID NO: 4120 - protein, 42 aa, synthetic construct
  REGION 1..42: note = Synthetic
DNLPSIGRAILNKRTTCMHDVGSKIYCGPKKQRFLLCWSTKL

SEQ ID NO: 4121 - protein, 20 aa, synthetic construct
  REGION 1..20: note = Synthetic
GGFRLGGHCGHPKIRCCRRK

SEQ ID NO: 4122 - protein, 29 aa, synthetic construct
  REGION 1..29: note = Synthetic
ENLHDIAHSLASGISDAIQKGVEDFEDVA

SEQ ID NO: 4123 - protein, 42 aa, synthetic construct
  REGION 1..42: note = Synthetic
KHVIGIASKLGKRSEEKRFWPFMGKRSEEKRFWPFMGKRSEE

SEQ ID NO: 4124 - protein, 27 aa, synthetic construct
  REGION 1..27: note = Synthetic
CQTFCSSLSAVLIGVCESGICCCILNQ

SEQ ID NO: 4125 - protein, 12 aa, synthetic construct
  REGION 1..12: note = Synthetic
VNKACSGCTHGK

SEQ ID NO: 4126 - protein, 33 aa, synthetic construct
  REGION 1..33: note = Synthetic
DDCAKYCSQFTDVHPACLGGYCECLRWEGGISS

SEQ ID NO: 4127 - protein, 36 aa, synthetic construct
  REGION 1..36: note = Synthetic
RGCKGFGDSCTPGKNERCPNYACSSKHKWCKVYLGK

SEQ ID NO: 4128 - protein, 40 aa, synthetic construct
  REGION 1..40: note = Synthetic
LDRASDGGNAVAKKSDVTARFNWRCCLIPACRRNHKKFCG

SEQ ID NO: 4129 - protein, 12 aa, synthetic construct
  REGION 1..12: note = Synthetic
METILEEVMTEV

SEQ ID NO: 4130 - protein, 28 aa, synthetic construct
  REGION 1..28: note = Synthetic
CRDWYDECCEGFYCSCRQPPKCICRNNN

SEQ ID NO: 4131 - protein, 15 aa, synthetic construct
  REGION 1..15: note = Synthetic
LEKVLNKAPRVVTSQ

SEQ ID NO: 4132 - protein, 11 aa, synthetic construct
  REGION 1..11: note = Synthetic
WRALETLLEDY

SEQ ID NO: 4133 - protein, 12 aa, synthetic construct
  REGION 1..12: note = Synthetic
FREVVDDLMGYD

SEQ ID NO: 4134 - protein, 12 aa, synthetic construct
  REGION 1..12: note = Synthetic
FREVVDDLMGYD

SEQ ID NO: 4135 - protein, 22 aa, synthetic construct
  REGION 1..22: note = Synthetic
DNVAQAWNDAFDQVYAIVLSRY

SEQ ID NO: 4136 - protein, 21 aa, synthetic construct
  REGION 1..21: note = Synthetic
GMAALMEELRGLGQGIQGQQY

SEQ ID NO: 4137 - protein, 20 aa, synthetic construct
  REGION 1..20: note = Synthetic
LAEQLMEKVKNLWYTRVLGY

SEQ ID NO: 4138 - protein, 24 aa, synthetic construct
  REGION 1..24: note = Synthetic
CAAHCLAIGRRGGSCERGVCICRR

SEQ ID NO: 4139 - protein, 24 aa, synthetic construct
  REGION 1..24: note = Synthetic
MYGGCGGNANNFKTIDECHRTCVG

SEQ ID NO: 4140 - protein, 20 aa, synthetic construct
  REGION 1..20: note = Synthetic
MAQYAAELRRYINMLTRPRY

SEQ ID NO: 4141 - protein, 28 aa, synthetic construct
  REGION 1..28: note = Synthetic
LMSTLKGAATNAAVTLLNKLQCKLTGTC

SEQ ID NO: 4142 - protein, 39 aa, synthetic construct
  REGION 1..39: note = Synthetic
TCVDSMADPVRVKRFWPLVPVAINTVAAGINLYKAIRRK

SEQ ID NO: 4143 - protein, 24 aa, synthetic construct
  REGION 1..24: note = Synthetic
RKIAQLLNKVADAAKKGEKVDMFD

SEQ ID NO: 4144 - protein, 21 aa, synthetic construct
  REGION 1..21: note = Synthetic
ATLERLLGQAPQSTQNQNAAK

SEQ ID NO: 4145 - protein, 42 aa, synthetic construct
  REGION 1..42: note = Synthetic
RSWTAVAGDGLKREIRRECAATCPPSKLGLTVFCCTTDNCNH

SEQ ID NO: 4146 - protein, 41 aa, synthetic construct
  REGION 1..41: note = Synthetic
CRCLKSVAGAYNAGRAAGIPSRCGVSVPYTISASVDCSKIH

SEQ ID NO: 4147 - protein, 39 aa, synthetic construct
  REGION 1..39: note = Synthetic
DLCNEALQSWQSAAPARTSAHLGLALACGLLALLWAPGL

SEQ ID NO: 4148 - protein, 22 aa, synthetic construct
  REGION 1..22: note = Synthetic
DVFDCISDMITDYCSGQMEDDH

SEQ ID NO: 4149 - protein, 27 aa, synthetic construct
  REGION 1..27: note = Synthetic
YLKSLYGGYGNGNGEFWEEYIDERYDK

SEQ ID NO: 4150 - protein, 17 aa, synthetic construct
  REGION 1..17: note = Synthetic
LIDVVDEYISGVQTVGK

SEQ ID NO: 4151 - protein, 17 aa, synthetic construct
  REGION 1..17: note = Synthetic
DIEDVANYVLSKADKGW

SEQ ID NO: 4152 - protein, 38 aa, synthetic construct
  REGION 1..38: note = Synthetic
RFCTEIGKDCGTSWECCEDCCIHGTCSHESNCANFKLR

SEQ ID NO: 4153 - protein, 26 aa, synthetic construct
  REGION 1..26: note = Synthetic
AKALFNKLTEYLKKKISGEDAAKKDT

SEQ ID NO: 4154 - protein, 21 aa, synthetic construct
  REGION 1..21: note = Synthetic
QSIADTIKDAFDKAQAVFMDA

SEQ ID NO: 4155 - protein, 25 aa, synthetic construct
  REGION 1..25: note = Synthetic
MKEYLESCEHACDSLIQEEIFNYFQ

SEQ ID NO: 4156 - protein, 32 aa, synthetic construct
  REGION 1..32: note = Synthetic
EKLDNALKYIIEKLKIHDTPEKICTDIHFCVV

SEQ ID NO: 4157 - protein, 39 aa, synthetic construct
  REGION 1..39: note = Synthetic
QYLEVIHSAVQILLSLVGFVYACYVISISMEEEDTCRNK

SEQ ID NO: 4158 - protein, 11 aa, synthetic construct
  REGION 1..11: note = Synthetic
WRALETLLEEY

SEQ ID NO: 4159 - protein, 11 aa, synthetic construct
  REGION 1..11: note = Synthetic
TGWRLCENILA

SEQ ID NO: 4160 - protein, 15 aa, synthetic construct
  REGION 1..15: note = Synthetic
NALALVNNFAAKHKH

SEQ ID NO: 4161 - protein, 14 aa, synthetic construct
  REGION 1..14: note = Synthetic
AGLMAAIFGAMLLL

SEQ ID NO: 4162 - protein, 30 aa, synthetic construct
  REGION 1..30: note = Synthetic
RCRDWYNDCCDGFYCSCRQPPYCICRNNNG

SEQ ID NO: 4163 - protein, 22 aa, synthetic construct
  REGION 1..22: note = Synthetic
KSFKDFLQNILHLAEAHAVKRG

SEQ ID NO: 4164 - protein, 27 aa, synthetic construct
  REGION 1..27: note = Synthetic
ADQAANEWGRSGKDPNHFRPAGLPDKY

SEQ ID NO: 4165 - protein, 27 aa, synthetic construct
  REGION 1..27: note = Synthetic
ADQAANEWGRSGKDPNHFRPKGLPDKY

SEQ ID NO: 4166 - protein, 27 aa, synthetic construct
  REGION 1..27: note = Synthetic
ADQAANEWGRSGKDPNHFRPKGLPDKY

SEQ ID NO: 4167 - protein, 22 aa, synthetic construct
  REGION 1..22: note = Synthetic
LMEHIKEFFNEMLTKEDVKLFD

SEQ ID NO: 4168 - protein, 42 aa, synthetic construct
  REGION 1..42: note = Synthetic
CMKSAASSITKLNTNNAAALPGKCGVNIPYKISTSTNCNTVK

SEQ ID NO: 4169 - protein, 24 aa, synthetic construct
  REGION 1..24: note = Synthetic
NDCQRYCQSVKECKYGKCYCNYAG

SEQ ID NO: 4170 - protein, 37 aa, synthetic construct
  REGION 1..37: note = Synthetic
GMRVVRGCAASCPSPIGGEEVSCCSTDNCNNSFSRFF

SEQ ID NO: 4171 - protein, 12 aa, synthetic construct
  REGION 1..12: note = Synthetic
GGCHELCHCCGS

SEQ ID NO: 4172 - protein, 11 aa, synthetic construct
  REGION 1..11: note = Synthetic
VAMIEAVIEKY

SEQ ID NO: 4173 - protein, 16 aa, synthetic construct
  REGION 1..16: note = Synthetic
FSNAAQSIASDAQNLG

SEQ ID NO: 4174 - protein, 31 aa, synthetic construct
  REGION 1..31: note = Synthetic
WQVIGQLVSTGAIMLLGPAIIILLALKKGNL

SEQ ID NO: 4175 - protein, 27 aa, synthetic construct
  REGION 1..27: note = Synthetic
SVARHAARDLRRWMWCNLKVCVGGLVV

SEQ ID NO: 4176 - protein, 12 aa, synthetic construct
  REGION 1..12: note = Synthetic
GLPKVMNEAGRR

SEQ ID NO: 4177 - protein, 30 aa, synthetic construct
  REGION 1..30: note = Synthetic
VNQVAKSINDLDYTPIMKSMENLDNGMDML

SEQ ID NO: 4178 - protein, 18 aa, synthetic construct
  REGION 1..18: note = Synthetic
NILSSIVNGINRALSFFG

SEQ ID NO: 4179 - protein, 31 aa, synthetic construct
  REGION 1..31: note = Synthetic
RRLKGVAKKGLGKGCFGLKLDRIGSMSGLGC

SEQ ID NO: 4180 - protein, 25 aa, synthetic construct
  REGION 1..25: note = Synthetic
GLLSVLGSVAKHVLPHVVPVIAEHL

SEQ ID NO: 4181 - protein, 25 aa, synthetic construct
  REGION 1..25: note = Synthetic
GLLSVLGSVAKHVLPHVVPVIAEHL

SEQ ID NO: 4182 - protein, 25 aa, synthetic construct
  REGION 1..25: note = Synthetic
GLLSVLGSVAKHVLPHVVPVIAEHL

SEQ ID NO: 4183 - protein, 25 aa, synthetic construct
  REGION 1..25: note = Synthetic
GLLSVLGSVAKHVLPHVVPVIAEHL

SEQ ID NO: 4184 - protein, 20 aa, synthetic construct
  REGION 1..20: note = Synthetic
AGGCATGFLRTADGRCKPTF

SEQ ID NO: 4185 - protein, 39 aa, synthetic construct
  REGION 1..39: note = Synthetic
TGMAGGEEAIGGQFMQRMVKKSVPFKPRLGKRAQVCGGD

SEQ ID NO: 4186 - protein, 20 aa, synthetic construct
  REGION 1..20: note = Synthetic
MAEYVADLRRYINMLTRPRY

SEQ ID NO: 4187 - protein, 30 aa, synthetic construct
  REGION 1..30: note = Synthetic
AISKIVDAAEDILQQALNAVPDAHHNCVFG

SEQ ID NO: 4188 - protein, 13 aa, synthetic construct
  REGION 1..13: note = Synthetic
AAKEFVSWLKTGR

SEQ ID NO: 4189 - protein, 13 aa, synthetic construct
  REGION 1..13: note = Synthetic
AAKEFVSWLKTGR

SEQ ID NO: 4190 - protein, 12 aa, synthetic construct
  REGION 1..12: note = Synthetic
ICTNYGQCVRHF

SEQ ID NO: 4191 - protein, 20 aa, synthetic construct
  REGION 1..20: note = Synthetic
VLDIFKDAAKQILAHAAEQI

SEQ ID NO: 4192 - protein, 41 aa, synthetic construct
  REGION 1..41: note = Synthetic
RNLKRAMATGSGSNLRLRKSEMPADPYHVTICEIWGEESSS

SEQ ID NO: 4193 - protein, 15 aa, synthetic construct
  REGION 1..15: note = Synthetic
LANTINQLATKCLSK

SEQ ID NO: 4194 - protein, 16 aa, synthetic construct
  REGION 1..16: note = Synthetic
RDVVRDAQELVNNLTA

SEQ ID NO: 4195 - protein, 25 aa, synthetic construct
  REGION 1..25: note = Synthetic
GLLGVLGSVAKHVLPHVVPVIAEHL

SEQ ID NO: 4196 - protein, 15 aa, synthetic construct
  REGION 1..15: note = Synthetic
FPDCCNSICAQFICL

SEQ ID NO: 4197 - protein, 20 aa, synthetic construct
  REGION 1..20: note = Synthetic
SQAGGGMSSFKTRVKSRILK

SEQ ID NO: 4198 - protein, 40 aa, synthetic construct
  REGION 1..40: note = Synthetic
VSELKRIGRELSVQNEVDRFSPGGPDPQHHSYPLSSKPRI

SEQ ID NO: 4199 - protein, 12 aa, synthetic construct
  REGION 1..12: note = Synthetic
LLDMVTGLLGNL

SEQ ID NO: 4200 - protein, 39 aa, synthetic construct
  REGION 1..39: note = Synthetic
GDLERAAASLPAFCNVDIPNGTGGVCYWLGYPRTPRTGH

SEQ ID NO: 4201 - protein, 26 aa, synthetic construct
  REGION 1..26: note = Synthetic
FQQALTDILDGMTEVAEETGEGGREG

SEQ ID NO: 4202 - protein, 12 aa, synthetic construct
  REGION 1..12: note = Synthetic
FQEAYRRFYGIA

SEQ ID NO: 4203 - protein, 33 aa, synthetic construct
  REGION 1..33: note = Synthetic
GRNAAANAFDLIALIARQNCCSIPSCWEKYKCS

SEQ ID NO: 4204 - protein, 21 aa, synthetic construct
  REGION 1..21: note = Synthetic
RTMAKTFIEWLEKQNSNDQTD

SEQ ID NO: 4205 - protein, 25 aa, synthetic construct
  REGION 1..25: note = Synthetic
IPDAIQRALDYIRSLPPPKENQKFK

SEQ ID NO: 4206 - protein, 25 aa, synthetic construct
  REGION 1..25: note = Synthetic
IPDAIQRALDYIRSLPPPKENQKFK

SEQ ID NO: 4207 - protein, 12 aa, synthetic construct
  REGION 1..12: note = Synthetic
VLNSLDNLVSGL

SEQ ID NO: 4208 - protein, 28 aa, synthetic construct
  REGION 1..28: note = Synthetic
LFKDGLNTVQEGLQKLNETFLQAPAAST

SEQ ID NO: 4209 - protein, 22 aa, synthetic construct
  REGION 1..22: note = Synthetic
AIKCIDHVCKFVSNLSQFEDLF

SEQ ID NO: 4210 - protein, 26 aa, synthetic construct
  REGION 1..26: note = Synthetic
TGLSNALDNLSSSHTKKRACFWKYCV

SEQ ID NO: 4211 - protein, 21 aa, synthetic construct
  REGION 1..21: note = Synthetic
GMAALMEELRGLGQGIQGQQY

SEQ ID NO: 4212 - protein, 21 aa, synthetic construct
  REGION 1..21: note = Synthetic
GMAALMEELRGLGQGIQGQQY

SEQ ID NO: 4213 - protein, 21 aa, synthetic construct
  REGION 1..21: note = Synthetic
GMAALMEELRGLGQGIQGQQY

SEQ ID NO: 4214 - protein, 21 aa, synthetic construct
  REGION 1..21: note = Synthetic
GMAALMEELRGLGQGIQGQQY

SEQ ID NO: 4215 - protein, 21 aa, synthetic construct
  REGION 1..21: note = Synthetic
GMAALMEELRGLGQGIQGQQY

SEQ ID NO: 4216 - protein, 12 aa, synthetic construct
  REGION 1..12: note = Synthetic
FQEAYQRFYGPV

SEQ ID NO: 4217 - protein, 25 aa, synthetic construct
  REGION 1..25: note = Synthetic
SDAAKKLQEFITFEKGIDGPFTSKN

SEQ ID NO: 4218 - protein, 42 aa, synthetic construct
  REGION 1..42: note = Synthetic
CLKSAYNSISGVNAGNAASFPGKCGVSIPYKISPSTDCSKVQ

SEQ ID NO: 4219 - protein, 26 aa, synthetic construct
  REGION 1..26: note = Synthetic
GGGGKKCGGHGEYGSGVIIGAERPKK

SEQ ID NO: 4220 - protein, 18 aa, synthetic construct
  REGION 1..18: note = Synthetic
NILSSIANGINRALSFFG

SEQ ID NO: 4221 - protein, 15 aa, synthetic construct
  REGION 1..15: note = Synthetic
RFLEGLLNTVTGLLG

SEQ ID NO: 4222 - protein, 23 aa, synthetic construct
  REGION 1..23: note = Synthetic
GIVDQCCNNICTFNQLQNYCNVP

SEQ ID NO: 4223 - protein, 21 aa, synthetic construct
  REGION 1..21: note = Synthetic
TAVKLFRNFLTSFFNNQASTG

SEQ ID NO: 4224 - protein, 16 aa, synthetic construct
  REGION 1..16: note = Synthetic
KLAKTVAKQAAKKQME

SEQ ID NO: 4225 - protein, 27 aa, synthetic construct
  REGION 1..27: note = Synthetic
RILEDIVSTALATCCKFQFLNFCCNEK

SEQ ID NO: 4226 - protein, 21 aa, synthetic construct
  REGION 1..21: note = Synthetic
LRDLKGALESLIEEETGQKKI

SEQ ID NO: 4227 - protein, 28 aa, synthetic construct
  REGION 1..28: note = Synthetic
QQCLKPCKAAFGISAGGKCINGKCKCYP

SEQ ID NO: 4228 - protein, 38 aa, synthetic construct
  REGION 1..38: note = Synthetic
ITKASTCAKKIFKRHNFRAWYGWRNHCDGKTLPDTSNC

SEQ ID NO: 4229 - protein, 26 aa, synthetic construct
  REGION 1..26: note = Synthetic
ACAGGCVSICGHCAPTCGCGYGGLYY

SEQ ID NO: 4230 - protein, 23 aa, synthetic construct
  REGION 1..23: note = Synthetic
TDFYKVFEKCWDVVSAASSPTAT

SEQ ID NO: 4231 - protein, 27 aa, synthetic construct
  REGION 1..27: note = Synthetic
DLWNSIKDMAAAAGRAALNAVTGMVNQ

SEQ ID NO: 4232 - protein, 39 aa, synthetic construct
  REGION 1..39: note = Synthetic
DMAKSALRELKSCIDELQPVHKEQLVKLLVQVLDAQEDT

SEQ ID NO: 4233 - protein, 19 aa, synthetic construct
  REGION 1..19: note = Synthetic
SELESVLRKLLDQAKAITQ

SEQ ID NO: 4234 - protein, 38 aa, synthetic construct
  REGION 1..38: note = Synthetic
VDHLGTEVKGLLGLLEELAWNLPPGPFSPAPDLLGDGF

SEQ ID NO: 4235 - protein, 12 aa, synthetic construct
  REGION 1..12: note = Synthetic
FQEAYRRFYGTA

SEQ ID NO: 4236 - protein, 17 aa, synthetic construct
  REGION 1..17: note = Synthetic
VANYVDQVVNSAGDAHG

SEQ ID NO: 4237 - protein, 38 aa, synthetic construct
  REGION 1..38: note = Synthetic
NCAKKIVSGAGGMKNWVKWRLHCAGRPLSYWMTGCHLA

SEQ ID NO: 4238 - protein, 24 aa, synthetic construct
  REGION 1..24: note = Synthetic
EMMNKAFYPINQVICYFNDPSQCP

SEQ ID NO: 4239 - protein, 32 aa, synthetic construct
  REGION 1..32: note = Synthetic
YGGCGGNANNFHTLEECVKVCGVRSRDSPKEN

SEQ ID NO: 4240 - protein, 31 aa, synthetic construct
  REGION 1..31: note = Synthetic
LQQFAEQFMEIIQQIYNSLGYPGIEEKEKVQ

SEQ ID NO: 4241 - protein, 11 aa, synthetic construct
  REGION 1..11: note = Synthetic
VTMIEAVMEKY

SEQ ID NO: 4242 - protein, 33 aa, synthetic construct
  REGION 1..33: note = Synthetic
FGKRALRDLNKYDYMSDPSFSAEDIKALRELFR

SEQ ID NO: 4243 - protein, 17 aa, synthetic construct
  REGION 1..17: note = Synthetic
MKCCSNGCGHACKPPVF

SEQ ID NO: 4244 - protein, 17 aa, synthetic construct
  REGION 1..17: note = Synthetic
MKCCSNGCGHACKPPVF

SEQ ID NO: 4245 - protein, 26 aa, synthetic construct
  REGION 1..26: note = Synthetic
DHAKRILQTFESRYDCCKTFECCHWG

SEQ ID NO: 4246 - protein, 13 aa, synthetic construct
  REGION 1..13: note = Synthetic
QYSRLGGNWARNK

SEQ ID NO: 4247 - protein, 25 aa, synthetic construct
  REGION 1..25: note = Synthetic
WLAGCPSGWHNCKSSGQLIGACCKQ

SEQ ID NO: 4248 - protein, 24 aa, synthetic construct
  REGION 1..24: note = Synthetic
DLTDAMEDVLDIFEEGIIPQKKEL

SEQ ID NO: 4249 - protein, 24 aa, synthetic construct
  REGION 1..24: note = Synthetic
DLTDAMEDVLDIFEEGIIPQKKEL

SEQ ID NO: 4250 - protein, 24 aa, synthetic construct
  REGION 1..24: note = Synthetic
DLTDAMEDVLDIFEEGIIPQKKEL

SEQ ID NO: 4251 - protein, 24 aa, synthetic construct
  REGION 1..24: note = Synthetic
DLTDAMEDVLDIFEEGIIPQKKEL

SEQ ID NO: 4252 - protein, 24 aa, synthetic construct
  REGION 1..24: note = Synthetic
DLTDAMEDVLDIFEEGIIPQKKEL

SEQ ID NO: 4253 - protein, 24 aa, synthetic construct
  REGION 1..24: note = Synthetic
DLTDAMEDVLDIFEEGIIPQKKEL

SEQ ID NO: 4254 - protein, 35 aa, synthetic construct
  REGION 1..35: note = Synthetic
FQSLKEFMDACDILGLSKAAVILPKDASRTHTILP

SEQ ID NO: 4255 - protein, 23 aa, synthetic construct
  REGION 1..23: note = Synthetic
REAERLAYEATSVANDVHDHQAP

SEQ ID NO: 4256 - protein, 20 aa, synthetic construct
  REGION 1..20: note = Synthetic
LAEQLMEKIKTLWYTKVLGY

SEQ ID NO: 4257 - protein, 18 aa, synthetic construct
  REGION 1..18: note = Synthetic
NILSSIANGINRALSFFG

SEQ ID NO: 4258 - protein, 33 aa, synthetic construct
  REGION 1..33: note = Synthetic
SSLKDYCSTFKGKFTGFWDSASEAKPTPASDAF

SEQ ID NO: 4259 - protein, 21 aa, synthetic construct
  REGION 1..21: note = Synthetic
GEAFAAALDGFRRLPYRLSSE

SEQ ID NO: 4260 - protein, 41 aa, synthetic construct
  REGION 1..41: note = Synthetic
ADNVIGFCQECAHHCLQRKRVLGECRWFTCHCSRITIGVGL

SEQ ID NO: 4261 - protein, 21 aa, synthetic construct
  REGION 1..21: note = Synthetic
DTFGAQLQSLLKKKMILEMIN

SEQ ID NO: 4262 - protein, 16 aa, synthetic construct
  REGION 1..16: note = Synthetic
EAEDAASYFCHQWSSY

SEQ ID NO: 4263 - protein, 33 aa, synthetic construct
  REGION 1..33: note = Synthetic
DLVRNIKNLISSIVTAIVTAVTTVLATEGNING

SEQ ID NO: 4264 - protein, 25 aa, synthetic construct
  REGION 1..25: note = Synthetic
LDSMKGYWTSLIGRLSGFLDSTPSS

SEQ ID NO: 4265 - protein, 32 aa, synthetic construct
  REGION 1..32: note = Synthetic
LSNMLRNLMHLVNQTKCPVNETKITKLQDFLS

SEQ ID NO: 4266 - protein, 24 aa, synthetic construct
  REGION 1..24: note = Synthetic
LRGCASTCHEGPYNVCCSTDLCNK

SEQ ID NO: 4267 - protein, 23 aa, synthetic construct
  REGION 1..23: note = Synthetic
AKTGYKGLGHCLGEYDECQSRSY

SEQ ID NO: 4268 - protein, 24 aa, synthetic construct
  REGION 1..24: note = Synthetic
AAKECHDVLSSFSRLALLSPCPMS

SEQ ID NO: 4269 - protein, 27 aa, synthetic construct
  REGION 1..27: note = Synthetic
IATFVTDIFQGAKYFRVKMDIKLYECY

SEQ ID NO: 4270 - protein, 11 aa, synthetic construct
  REGION 1..11: note = Synthetic
LEDCDNACARY

SEQ ID NO: 4271 - protein, 16 aa, synthetic construct
  REGION 1..16: note = Synthetic
TQYSRLGGNWPRNKKS

SEQ ID NO: 4272 - protein, 33 aa, synthetic construct
  REGION 1..33: note = Synthetic
EICDRGCKRYGATSGFCKEFSKGENFCWCKGLR

SEQ ID NO: 4273 - protein, 13 aa, synthetic construct
  REGION 1..13: note = Synthetic
GKDLSDWVDGCEL

SEQ ID NO: 4274 - protein, 11 aa, synthetic construct
  REGION 1..11: note = Synthetic
VAMIEAVMEKY

SEQ ID NO: 4275 - protein, 21 aa, synthetic construct
  REGION 1..21: note = Synthetic
GFLHHGCRCCARADEVPEVRN

SEQ ID NO: 4276 - protein, 29 aa, synthetic construct
  REGION 1..29: note = Synthetic
AVKKYLNSILNGKRSSEGDSADFLEELEK

SEQ ID NO: 4277 - protein, 29 aa, synthetic construct
  REGION 1..29: note = Synthetic
AVKKYLNSILNGKRSSEGESPDFPEELEK

SEQ ID NO: 4278 - protein, 29 aa, synthetic construct
  REGION 1..29: note = Synthetic
AVKKYLNSILNGKRSSEGDSPDFLEELEK

SEQ ID NO: 4279 - protein, 29 aa, synthetic construct
  REGION 1..29: note = Synthetic
AVKKYLNSILNGKRSSEGESPDFLEELEK

SEQ ID NO: 4280 - protein, 31 aa, synthetic construct
  REGION 1..31: note = Synthetic
RDAGNVLDHGFQRRRECPPRCPTSHCNAGTC

SEQ ID NO: 4281 - protein, 26 aa, synthetic construct
  REGION 1..26: note = Synthetic
YSIIDKLGKIVDDLVLCMEENAPKLT

SEQ ID NO: 4282 - protein, 24 aa, synthetic construct
  REGION 1..24: note = Synthetic
AENMLQLVSDFLTSASLISSTNIH

SEQ ID NO: 4283 - protein, 22 aa, synthetic construct
  REGION 1..22: note = Synthetic
SNFKDLVDSLLQVLNVKEGTPS

SEQ ID NO: 4284 - protein, 11 aa, synthetic construct
  REGION 1..11: note = Synthetic
INAVSALANHG

SEQ ID NO: 4285 - protein, 22 aa, synthetic construct
  REGION 1..22: note = Synthetic
ICKSFQSLVHRFGHVTVAPTSV

SEQ ID NO: 4286 - protein, 29 aa, synthetic construct
  REGION 1..29: note = Synthetic
KAGASSITDVGACTFLFFANTLMCLFYLS

SEQ ID NO: 4287 - protein, 30 aa, synthetic construct
  REGION 1..30: note = Synthetic
KFVSDVADYFWKMAKMSGKVIGNGIANQNE

SEQ ID NO: 4288 - protein, 30 aa, synthetic construct; identical to SEQ ID NO: 4287
  REGION 1..30: note = Synthetic

SEQ ID NO: 4289 - protein, 21 aa, synthetic construct
  REGION 1..21: note = Synthetic
SRLCQLMDKLIRNADNEASLK

SEQ ID NO: 4290 - protein, 17 aa, synthetic construct
  REGION 1..17: note = Synthetic
VENLANELNHLLTHARN

SEQ ID NO: 4291 - protein, 15 aa, synthetic construct
  REGION 1..15: note = Synthetic
SFYTILADCCRRPRG

SEQ ID NO: 4292 - protein, 15 aa, synthetic construct
  REGION 1..15: note = Synthetic
SYPQYMTSGYASNWN

SEQ ID NO: 4293 - protein, 15 aa, synthetic construct
  REGION 1..15: note = Synthetic
SYPQYMTSGYASNWN

SEQ ID NO: 4294 - protein, 20 aa, synthetic construct
  REGION 1..20: note = Synthetic
LAQYYSDLYQYITFITRPRF

SEQ ID NO: 4295 - protein, 18 aa, synthetic construct
  REGION 1..18: note = Synthetic
DSLKSFIEEAAKEVTTEA

SEQ ID NO: 4296 - protein, 24 aa, synthetic construct
  REGION 1..24: note = Synthetic
DLTDAMEDVLDIFEEGIIPQKKEL

SEQ ID NO: 4297 - protein, 15 aa, synthetic construct
  REGION 1..15: note = Synthetic
LFSNIGYVITDMLES

SEQ ID NO: 4298 - protein, 34 aa, synthetic construct
  REGION 1..34: note = Synthetic
KVAEKVADKIKEAAEVVKTVVADSDDAGQEHNEL

SEQ ID NO: 4299 - protein, 16 aa, synthetic construct
  REGION 1..16: note = Synthetic
NLFSNIGYVITDMLES

SEQ ID NO: 4300 - protein, 42 aa, synthetic construct
  REGION 1..42: note = Synthetic
KLWEGFKSIVGKRGLNDRDQLDDLFDSDLSDADIKLLKEMFK

SEQ ID NO: 4301 - protein, 30 aa, synthetic construct
  REGION 1..30: note = Synthetic
LRYIRGCAATCPGTKPRDMVECCSTDRCNR

SEQ ID NO: 4302 - protein, 30 aa, synthetic construct; identical to SEQ ID NO: 4301
  REGION 1..30: note = Synthetic

SEQ ID NO: 4303 - protein, 26 aa, synthetic construct
  REGION 1..26: note = Synthetic
NNLRKIADQACDNLTDNVNDFIPQEY

SEQ ID NO: 4304 - protein, 20 aa, synthetic construct
  REGION 1..20: note = Synthetic
SELLSIVRDIAESFWDCPYD

SEQ ID NO: 4305 - protein, 18 aa, synthetic construct
  REGION 1..18: note = Synthetic
CSRCCSYAGEAVQTQPGH

SEQ ID NO: 4306 - protein, 37 aa, synthetic construct
  REGION 1..37: note = Synthetic
STGVEKLRDIYDKSVDAVGTYTSILTDQLYHWWCGEQ

SEQ ID NO: 4307 - protein, 13 aa, synthetic construct
  REGION 1..13: note = Synthetic
KRLTKMGGDLNSP

SEQ ID NO: 4308 - protein, 41 aa, synthetic construct
  REGION 1..41: note = Synthetic
SLQDAGAGAGRRCICTTRTCRFPYRRLGTCIFQNRVYTFCC

SEQ ID NO: 4309 - protein, 41 aa, synthetic construct
  REGION 1..41: note = Synthetic
SLQDAGAGAGRRCICTTRTCRFPYRRLGTCLFQNRVYTFCC

SEQ ID NO: 4310 - protein, 11 aa, synthetic construct
  REGION 1..11: note = Synthetic
ISAVSALADHF

SEQ ID NO: 4311 - protein, 37 aa, synthetic construct
  REGION 1..37: note = Synthetic
LSSLQDYWSSFKGKWSGFGFWDATPEEASPTPAPEGI

SEQ ID NO: 4312 - protein, 34 aa, synthetic construct
  REGION 1..34: note = Synthetic
SDLCSLAKTAFSDCTAYVAGAELKACTLAQGKII

SEQ ID NO: 4313 - protein, 37 aa, synthetic construct
  REGION 1..37: note = Synthetic
YGGCGGNANNFSSYYECHIKCFGPRAIIFPEDSPKEN

SEQ ID NO: 4314 - protein, 22 aa, synthetic construct
  REGION 1..22: note = Synthetic
LMENIQDAFKDAVDSSDEHTLH

SEQ ID NO: 4315 - protein, 22 aa, synthetic construct
  REGION 1..22: note = Synthetic
LMENIQDAFKDAVDSSDEHTLH

SEQ ID NO: 4316 - protein, 30 aa, synthetic construct
  REGION 1..30: note = Synthetic
KFVSEVADYFWKMAKMSGKVIGNGIASQNE

SEQ ID NO: 4317 - protein, 33 aa, synthetic construct
  REGION 1..33: note = Synthetic
AAGGDRVFDAVVVVKAWLKSKELVSFTPASSTK

SEQ ID NO: 4318 - protein, 33 aa, synthetic construct; identical to SEQ ID NO: 4317
  REGION 1..33: note = Synthetic

SEQ ID NO: 4319 - protein, 39 aa, synthetic construct
  REGION 1..39: note = Synthetic
LLNQVTEIINDWQEKDDSQRKDIFDLKEKFPFVDFIGFD

SEQ ID NO: 4320 - protein, 25 aa, synthetic construct
  REGION 1..25: note = Synthetic
VLSAYWKDLNNYHRFSGMGFGPETP

SEQ ID NO: 4321 - protein, 32 aa, synthetic construct
  REGION 1..32: note = Synthetic
TPLKSGASSIIDAGACSFLFFANTLMCLFYLS

SEQ ID NO: 4322 - protein, 13 aa, synthetic construct
  REGION 1..13: note = Synthetic
KRLTKMGGDLNSP

SEQ ID NO: 4323 - protein, 35 aa, synthetic construct
  REGION 1..35: note = Synthetic
EVIDDIKEAVNQVCNGNVVSCADILVAAARDSVVE

SEQ ID NO: 4324 - protein, 28 aa, synthetic construct
  REGION 1..28: note = Synthetic
MIDECRKLMKSCDYFLLLDADMILKVHP

SEQ ID NO: 4325 - protein, 20 aa, synthetic construct
  REGION 1..20: note = Synthetic
NTALNAAKNFVAEKIGATPS

SEQ ID NO: 4326 - protein, 15 aa, synthetic construct
  REGION 1..15: note = Synthetic
DLSSVAKTLIHRLHK

SEQ ID NO: 4327 - protein, 26 aa, synthetic construct
  REGION 1..26: note = Synthetic
HAFEFMQRALQDLKKTAYNLDTRVRT

SEQ ID NO: 4328 - protein, 34 aa, synthetic construct
  REGION 1..34: note = Synthetic
HAFEFMQRALQDLKKTAYNLDTRVCVSIEMLLLR

SEQ ID NO: 4329 - protein, 13 aa, synthetic construct
  REGION 1..13: note = Synthetic
GKDLTDWVDGCDL

SEQ ID NO: 4330 - protein, 12 aa, synthetic construct
  REGION 1..12: note = Synthetic
FYGSYVGLGSSL

SEQ ID NO: 4331 - protein, 28 aa, synthetic construct
  REGION 1..28: note = Synthetic
QELSTLLEKVLNWISFFKILKRMWRDTK

SEQ ID NO: 4332 - protein, 24 aa, synthetic construct
  REGION 1..24: note = Synthetic
CAAHCLAIGRKGGSCQNGVCVCRN

SEQ ID NO: 4333 - protein, 41 aa, synthetic construct
  REGION 1..41: note = Synthetic
CEGWADAGCGLLELLDTSGAPEKRQHPGRRAELEDELPGLE

SEQ ID NO: 4334 - protein, 26 aa, synthetic construct
  REGION 1..26: note = Synthetic
IATFVTDIFQGAKYFRVKMDVKLYEC

SEQ ID NO: 4335 - protein, 26 aa, synthetic construct
  REGION 1..26: note = Synthetic
IATFVTDIFQGAKYFRVKMDVKLYEC

SEQ ID NO: 4336 - protein, 37 aa, synthetic construct
  REGION 1..37: note = Synthetic
TFMGCLKNCADVKGIRWSVYLVNFRCCRSHDLCNEDL

SEQ ID NO: 4337 - protein, 29 aa, synthetic construct
  REGION 1..29: note = Synthetic
HRCHRGGNGGYGGGSGEVVVIGAEKPKDK

SEQ ID NO: 4338 - protein, 31 aa, synthetic construct
  REGION 1..31: note = Synthetic
CAKVKGICKTFCDDDEYDYGYCIKWRNQCCI

SEQ ID NO: 4339 - protein, 24 aa, synthetic construct
  REGION 1..24: note = Synthetic
ATFGKQICGKCEQESTELHCHCRR

SEQ ID NO: 4340 - protein, 26 aa, synthetic construct
  REGION 1..26: note = Synthetic
AAFDAIGTRFNDEAQKQLAHHGLPHT

SEQ ID NO: 4341 - protein, 36 aa, synthetic construct
  REGION 1..36: note = Synthetic
NTALNAAKNLVAEKIGATPSEAGQMPFDEFMDILYE

SEQ ID NO: 4342 - protein, 36 aa, synthetic construct
  REGION 1..36: note = Synthetic
CYDCFREGLTKVYSYCCHKYNHMYEWCLEYFSGEMK

SEQ ID NO: 4343 - protein, 24 aa, synthetic construct
  REGION 1..24: note = Synthetic
ILNAFGQAMTAMGNAVSRYYCDAE

SEQ ID NO: 4344 - protein, 26 aa, synthetic construct
  REGION 1..26: note = Synthetic
IATFVTDIFQGAKYFRVKMDVKLYEC

SEQ ID NO: 4345 - protein, 27 aa, synthetic construct
  REGION 1..27: note = Synthetic
SWGDNVAAAWEHALENTYTVAFEVIPA

SEQ ID NO: 4346 - protein, 29 aa, synthetic construct
  REGION 1..29: note = Synthetic
SLADQAANEWGRSGKDPNHFRPAGLPEKY

SEQ ID NO: 4347 - protein, 30 aa, synthetic construct
  REGION 1..30: note = Synthetic
KFVKDVADYFWEMAKISGQVVSNGIANQNE

SEQ ID NO: 4348 - protein, 27 aa, synthetic construct
  REGION 1..27: note = Synthetic
YLKSLYGGYGNGNGEFREEYIDERYDN

SEQ ID NO: 4349 - protein, 30 aa, synthetic construct
  REGION 1..30: note = Synthetic
KVGGLLGTLAEELNGYSRKKGGFSFRFGRR

SEQ ID NO: 4350 - protein, 25 aa, synthetic construct
  REGION 1..25: note = Synthetic
LRTVAELLNKVADAAEKKENIDFFN

SEQ ID NO: 4351 - protein, 41 aa, synthetic construct
  REGION 1..41: note = Synthetic
ISAIANQVKNGKNAMPSFSRLSDSDIEDVANYVLSKADKGW

SEQ ID NO: 4352 - protein, 17 aa, synthetic construct
  REGION 1..17: note = Synthetic
KCCKNGCGFMTCTTARP

SEQ ID NO: 4353 - protein, 27 aa, synthetic construct
  REGION 1..27: note = Synthetic
SGYNGVGKCFDDPKVPGRSNCGCLYNC

SEQ ID NO: 4354 - protein, 11 aa, synthetic construct
  REGION 1..11: note = Synthetic
YTAVADCCHQA

SEQ ID NO: 4355 - protein, 26 aa, synthetic construct
  REGION 1..26: note = Synthetic
AIWSGFKNWVNTDCASHNPFVCKSPA

SEQ ID NO: 4356 - protein, 12 aa, synthetic construct
  REGION 1..12: note = Synthetic
EYLENWVKEFED

SEQ ID NO: 4357 - protein, 17 aa, synthetic construct
  REGION 1..17: note = Synthetic
GQHAGGKCINGKCKCYP

SEQ ID NO: 4358 - protein, 17 aa, synthetic construct
  REGION 1..17: note = Synthetic
GQHAGGKCINGKCKCYP

SEQ ID NO: 4359 - protein, 37 aa, synthetic construct
  REGION 1..37: note = Synthetic
HRLAGLLSSAGSMANSNLLPTEMGFKVSGRRRRDLQA

SEQ ID NO: 4360 - protein, 26 aa, synthetic construct
  REGION 1..26: note = Synthetic
IATFVTDIFQGAKYFRVKMDIKLYEC

SEQ ID NO: 4361 - protein, 30 aa, synthetic construct; identical to SEQ ID NO: 4301
  REGION 1..30: note = Synthetic

SEQ ID NO: 4362 - protein, 30 aa, synthetic construct
  REGION 1..30: note = Synthetic
LRYIRGCAATCPGTKPRDMVECCNTDRCNR

SEQ ID NO: 4363 - protein, 32 aa, synthetic construct
  REGION 1..32: note = Synthetic
RKLETVVNEIVDEMNYLKRRETKLRDTNGKLL

SEQ ID NO: 4364 - protein, 24 aa, synthetic construct
  REGION 1..24: note = Synthetic
FCQACWRFAGTCGPYVGRAMAIGV

SEQ ID NO: 4365 - protein, 30 aa, synthetic construct; identical to SEQ ID NO: 4301
  REGION 1..30: note = Synthetic

SEQ ID NO: 4366 - protein, 28 aa, synthetic construct
  REGION 1..28: note = Synthetic
ASSIFKTLRTIANDDCELCVNVACTGCL

SEQ ID NO: 4367 - protein, 28 aa, synthetic construct
  REGION 1..28: note = Synthetic
ASSIFKTLRTIANDDCELCVNVACTGCL

SEQ ID NO: 4368 - protein, 28 aa, synthetic construct
  REGION 1..28: note = Synthetic
ASSIFKTLRTIANDDCELCVNVACTGCL

SEQ ID NO: 4369 - protein, 29 aa, synthetic construct
  REGION 1..29: note = Synthetic
AQEILQRLEEIAEDPSTCEICAYAACTGC

SEQ ID NO: 4370 - protein, 34 aa, synthetic construct
  REGION 1..34: note = Synthetic
NFNGILENGGTTLSKKTVLLLVTPFLAAAWSLHP

SEQ ID NO: 4371 - protein, 23 aa, synthetic construct
  REGION 1..23: note = Synthetic
HAFEFMQRALQDLKKTAYNLDTR

SEQ ID NO: 4372 - protein, 23 aa, synthetic construct
  REGION 1..23: note = Synthetic
HAFEFMQRALQDLKKTAYNLDTR

SEQ ID NO: 4373 - protein, 23 aa, synthetic construct
  REGION 1..23: note = Synthetic
HAFEFMQRALQDLKKTAYNLDTR

SEQ ID NO: 4374 - protein, 23 aa, synthetic construct
  REGION 1..23: note = Synthetic
HAFEFMQRALQDLKKTAYNLDTR

SEQ ID NO: 4375 - protein, 23 aa, synthetic construct
  REGION 1..23: note = Synthetic
HAFEFMQRALQDLKKTAYNLDTR

SEQ ID NO: 4376 - protein, 23 aa, synthetic construct
  REGION 1..23: note = Synthetic
HAFEFMQRALQDLKKTAYNLDTR

SEQ ID NO: 4377 - protein, 23 aa, synthetic construct
  REGION 1..23: note = Synthetic
HAFEFMQRALQDLKKTAYNLDTR

SEQ ID NO: 4378 - protein, 23 aa, synthetic construct
  REGION 1..23: note = Synthetic
HAFEFMQRALQDLKKTAYNLDMR

SEQ ID NO: 4379 - protein, 23 aa, synthetic construct
  REGION 1..23: note = Synthetic
HAFEFMQRALQDLKKTAYNLDAR

SEQ ID NO: 4380 - protein, 35 aa, synthetic construct
  REGION 1..35: note = Synthetic
GKQLGKQFRRGCAATCPEGKPNEIVQCCSTDECNH

SEQ ID NO: 4381 - protein, 21 aa, synthetic construct
  REGION 1..21: note = Synthetic
DPVNEICTSASNLCHTIRDEL

SEQ ID NO: 4382 - protein, 30 aa, synthetic construct
  REGION 1..30: note = Synthetic
AKEVEDLVSEIADELGDDVDDDAQTPEKTK

SEQ ID NO: 4383 - protein, 30 aa, synthetic construct
  REGION 1..30: note = Synthetic
CSKCFYTCAEKMKYCAKTCGFCTKGACKDC

SEQ ID NO: 4384 - protein, 19 aa, synthetic construct
  REGION 1..19: note = Synthetic
AITEMAECCSGFCLIYRCS

SEQ ID NO: 4385 - protein, 41 aa, synthetic construct
  REGION 1..41: note = Synthetic
SLEDAGAGAGRRCICTTRTCRFPYRRLGTCIFQNRVYTFCC

SEQ ID NO: 4386 - protein, 15 aa, synthetic construct
  REGION 1..15: note = Synthetic
LPHLASGLASLVLSK

SEQ ID NO: 4387 - protein, 13 aa, synthetic construct
  REGION 1..13: note = Synthetic
KRLTKMGGDLNSP

SEQ ID NO: 4388 - protein, 15 aa, synthetic construct
  REGION 1..15: note = Synthetic
DIRHALQNLLSTISQ

SEQ ID NO: 4389 - protein, 25 aa, synthetic construct
  REGION 1..25: note = Synthetic
VQRAIQIASSIIDEIEEFGRRVESC

SEQ ID NO: 4390 - protein, 24 aa, synthetic construct
  REGION 1..24: note = Synthetic
EAMNLLTYMLHGLSRRHNILRWLK

SEQ ID NO: 4391 - protein, 34 aa, synthetic construct
  REGION 1..34: note = Synthetic
REALEEFKKLVQRKGLSEEDIFTPLQTGSCVPEH

SEQ ID NO: 4392 - protein, 21 aa, synthetic construct
  REGION 1..21: note = Synthetic
QSIADTIKDAFDKAQAVFADA

SEQ ID NO: 4393 - protein, 32 aa, synthetic construct
  REGION 1..32: note = Synthetic
NEVMEKFNRALKTLPVHMQLLNPTQAEEQCLI

SEQ ID NO: 4394 - protein, 28 aa, synthetic construct
  REGION 1..28: note = Synthetic
ASSIFKTLRTIANDDCELCVNVACTGCL

SEQ ID NO: 4395 - protein, 33 aa, synthetic construct
  REGION 1..33: note = Synthetic
TRIYQIAKNLPNVCNMKQIGTCPFIAIPFFPPY

SEQ ID NO: 4396 - protein, 33 aa, synthetic construct; identical to SEQ ID NO: 4395
  REGION 1..33: note = Synthetic

SEQ ID NO: 4397 - protein, 33 aa, synthetic construct; identical to SEQ ID NO: 4395
  REGION 1..33: note = Synthetic

SEQ ID NO: 4398 - protein, 23 aa, synthetic construct
  REGION 1..23: note = Synthetic
DYGNSYFGYFDVWGAGTTVTVSS

SEQ ID NO: 4399 - protein, 26 aa, synthetic construct
  REGION 1..26: note = Synthetic
AFDFLTHVLHLVSDADAEHHLLQSDE

SEQ ID NO: 4400 - protein, 15 aa, synthetic construct
  REGION 1..15: note = Synthetic
CQSVAASCARSCGSC

SEQ ID NO: 4401 - protein, 17 aa, synthetic construct
  REGION 1..17: note = Synthetic
CGDAHHFYRGCTCSCQG

SEQ ID NO: 4402 - protein, 23 aa, synthetic construct
  REGION 1..23: note = Synthetic
HAFEFMQRALQDLKKTAYNLDTR

SEQ ID NO: 4403 - protein, 23 aa, synthetic construct
  REGION 1..23: note = Synthetic
HAFEFMQRALQDLKKTAYNLDTR

SEQ ID NO: 4404 - protein, 23 aa, synthetic construct
  REGION 1..23: note = Synthetic
HAFEFMQRALQDLKKTAYNLDTR

SEQ ID NO: 4405 - protein, 23 aa, synthetic construct
  REGION 1..23: note = Synthetic
HAFEFMQRALQDLKKTAYNLDTR

SEQ ID NO: 4406 - protein, 23 aa, synthetic construct
  REGION 1..23: note = Synthetic
HAFEFMQRALQDLKKTAYNLDTR

SEQ ID NO: 4407 - protein, 23 aa, synthetic construct
  REGION 1..23: note = Synthetic
HAFEFMQRALQDLKKTAYNLDTR

SEQ ID NO: 4408 - protein, 23 aa, synthetic construct
  REGION 1..23: note = Synthetic
HAFEFMQRALQDLKKTAYNLDTR

SEQ ID NO: 4409 - protein, 23 aa, synthetic construct
  REGION 1..23: note = Synthetic
HAFEFMQRALQDLKKTAYNLDTR

SEQ ID NO: 4410 - protein, 35 aa, synthetic construct
  REGION 1..35: note = Synthetic
LRDLRDAFSRVKTFFQMKDQLDNLLLKESLLEDFK

SEQ ID NO: 4411 - protein, 26 aa, synthetic construct
  REGION 1..26: note = Synthetic
SWGDNVAAAWNHALDNTYAVALKSLE

SEQ ID NO: 4412 - protein, 26 aa, synthetic construct
  REGION 1..26: note = Synthetic
SWGDNVAAAWNHALDNTYAVALKSLE

SEQ ID NO: 4413 - protein, 34 aa, synthetic construct
  REGION 1..34: note = Synthetic
NTCSTFVHGGCQGNNNNFQSEANCLNTCKNKRFP

SEQ ID NO: 4414 - protein, 42 aa, synthetic construct
  REGION 1..42: note = Synthetic
CIDECKEIGAGYGYCYGFGCYCEGFPENKPTWPLPNKTCGRK

SEQ ID NO: 4415 - protein, 24 aa, synthetic construct
  REGION 1..24: note = Synthetic
KRLLEGIEKIISQAYPEAKGNEIY

SEQ ID NO: 4416 - protein, 34 aa, synthetic construct
  REGION 1..34: note = Synthetic
KIAEKVAEKVAEAANVVKTIVQDTDSDAQEHNEL

SEQ ID NO: 4417 - protein, 12 aa, synthetic construct
  REGION 1..12: note = Synthetic
LQDAYQRFYGPV

SEQ ID NO: 4418 - protein, 42 aa, synthetic construct
  REGION 1..42: note = Synthetic
CYGAAGTCARVVCDCDRTAALCFGDSEYIEGHKNIDTARFCQ

SEQ ID NO: 4419 - protein, 39 aa, synthetic construct
  REGION 1..39: note = Synthetic
QDMREAGAQLKKLVDTLPQKPRESIIKLMEKIAQSSLCN

SEQ ID NO: 4420 - protein, 42 aa, synthetic construct
  REGION 1..42: note = Synthetic
GGGGGGGGGGSRRLKGLPKKGLGSGCFGLKLDRIGSMSGLGC

SEQ ID NO: 4421 - protein, 15 aa, synthetic construct
  REGION 1..15: note = Synthetic
SVAGVAKKGYRKSSY

SEQ ID NO: 4422 - protein, 25 aa, synthetic construct
  REGION 1..25: note = Synthetic
EYYNNGGGLYSKDAKKELKDPSTSA

SEQ ID NO: 4423 - protein, 34 aa, synthetic construct
  REGION 1..34: note = Synthetic
LSRYAKLANRLANPKLLETFLSKWIGDRGNRSVK

SEQ ID NO: 4424 - protein, 24 aa, synthetic construct
  REGION 1..24: note = Synthetic
CAAHCLAIGRKGGACQNGVCVCRR

SEQ ID NO: 4425 - protein, 30 aa, synthetic construct
  REGION 1..30: note = Synthetic
MTSAVDFINEVIKHFQANPMAGRKIRSDEL

SEQ ID NO: 4426 - protein, 36 aa, synthetic construct
  REGION 1..36: note = Synthetic
ECDRVAANCFAENLKTYNKKYWLSSIIDCKEESEKC

SEQ ID NO: 4427 - protein, 21 aa, synthetic construct
  REGION 1..21: note = Synthetic
GVVDQCCTSICSLYQLQNYCN

SEQ ID NO: 4428 - protein, 24 aa, synthetic construct
  REGION 1..24: note = Synthetic
AVEQCTKACSTLCTKGSMTAVEAT

SEQ ID NO: 4429 - protein, 31 aa, synthetic construct
  REGION 1..31: note = Synthetic
NKGMEEFKKIVRTLTIPYTMIEAQTREMCRV

SEQ ID NO: 4430 - protein, 34 aa, synthetic construct; identical to SEQ ID NO: 4298
  REGION 1..34: note = Synthetic

SEQ ID NO: 4431 - protein, 34 aa, synthetic construct; identical to SEQ ID NO: 4298
  REGION 1..34: note = Synthetic

SEQ ID NO: 4432 - protein, 33 aa, synthetic construct
  REGION 1..33: note = Synthetic
SGYCQWVGKYGNGCWCIELPDNVPIRVPGKCHR

SEQ ID NO: 4433 - protein, 38 aa, synthetic construct
  REGION 1..38: note = Synthetic
DKAREVINRIKQSEFPAKTRDWFSETFRKVKEKLKINS

SEQ ID NO: 4434 - protein, 24 aa, synthetic construct
  REGION 1..24: note = Synthetic
AVERCTKACSTICTKGSKTAVETV

SEQ ID NO: 4435 - protein, 39 aa, synthetic construct
  REGION 1..39: note = Synthetic
DIATRCGGTGDSCNEPAGELCCRRLKCVNSRCCPTTDGC

SEQ ID NO: 4436 - protein, 22 aa, synthetic construct
  REGION 1..22: note = Synthetic
CGRAWSEGSKVCFICNRESSMC

SEQ ID NO: 4437 - protein, 17 aa, synthetic construct
  REGION 1..17: note = Synthetic
NKFLTILDQLINKIIVN

SEQ ID NO: 4438 - protein, 24 aa, synthetic construct
  REGION 1..24: note = Synthetic
AVDRCANACSTVCTKDSMNAVETA

SEQ ID NO: 4439 - protein, 22 aa, synthetic construct
  REGION 1..22: note = Synthetic
LMQKIQDAVKDALDSSDEHTLH

SEQ ID NO: 4440 - protein, 16 aa, synthetic construct
  REGION 1..16: note = Synthetic
NILNQIREVVSSALSG

SEQ ID NO: 4441 - protein, 26 aa, synthetic construct
  REGION 1..26: note = Synthetic
AAKTAADALAAAKKTAADAAAAAAKP

SEQ ID NO: 4442 - protein, 42 aa, synthetic construct
  REGION 1..42: note = Synthetic
LQNAGTQLKRLVDTLPQETRINIVKLTEKILTSPLCEQDLRV

SEQ ID NO: 4443 - protein, 38 aa, synthetic construct
  REGION 1..38: note = Synthetic
VGPCDQVCSRIDPEKDECCRAHGYRGHSSCYYGRMECY

SEQ ID NO: 4444 - protein, 20 aa, synthetic construct
  REGION 1..20: note = Synthetic
RLKGYLRAYCSQQKVCRCVQ

SEQ ID NO: 4445 - protein, 40 aa, synthetic construct
  REGION 1..40: note = Synthetic
SNIVRTIMEFLSFLHLKEAGALDSLPGIPLATSSEDLEQS

SEQ ID NO: 4446 - protein, 40 aa, synthetic construct
  REGION 1..40: note = Synthetic
SNIVRTIMEFLSFLHLKEAGALDSLPGIPLATSSEDLEKS

SEQ ID NO: 4447 - protein, 11 aa, synthetic construct
  REGION 1..11: note = Synthetic
DFTGIADSIIK

SEQ ID NO: 4448 - protein, 17 aa, synthetic construct
  REGION 1..17: note = Synthetic
DSILKLMDKIAKSPLCA

SEQ ID NO: 4449 - protein, 21 aa, synthetic construct
  REGION 1..21: note = Synthetic
RSFRNGVGTGMKKTSFQRAKS

SEQ ID NO: 4450 - protein, 11 aa, synthetic construct
  REGION 1..11: note = Synthetic
LSAALATWFSF

SEQ ID NO: 4451 - protein, 27 aa, synthetic construct
  REGION 1..27: note = Synthetic
QVGQILRECAKNLKNESTAEAFPGDEV

SEQ ID NO: 4452 - protein, 38 aa, synthetic construct
  REGION 1..38: note = Synthetic
ADCVGDGQKCADWFGPYCCSGYYCSCRSMPYCRCRSDS

SEQ ID NO: 4453 - protein, 32 aa, synthetic construct
  REGION 1..32: note = Synthetic
SYALTWIDECIRTCSRRGYTFAGTGVWFYISL

SEQ ID NO: 4454 - protein, 13 aa, synthetic construct
  REGION 1..13: note = Synthetic
LAGVLAVGAALVI

SEQ ID NO: 4455 - protein, 18 aa, synthetic construct
  REGION 1..18: note = Synthetic
KNVVEDIKKILQKMWPWK

SEQ ID NO: 4456 - protein, 11 aa, synthetic construct
  REGION 1..11: note = Synthetic
LSAALATWLSF

SEQ ID NO: 4457 - protein, 11 aa, synthetic construct
  REGION 1..11: note = Synthetic
LSAALATWLSF

SEQ ID NO: 4458 - protein, 11 aa, synthetic construct
  REGION 1..11: note = Synthetic
LSAALATWLSF

SEQ ID NO: 4459 - protein, 34 aa, synthetic construct
  REGION 1..34: note = Synthetic
ANKANRMMRKIMRKLPPDTLEELFQIYKKTRDQK

SEQ ID NO: 4460 - protein, 33 aa, synthetic construct
  REGION 1..33: note = Synthetic
RARDFVDDAVKEWEYDLTEVTNRNAPHCRPNCC

SEQ ID NO: 4461 - protein, 23 aa, synthetic construct
  REGION 1..23: note = Synthetic
GQPLGKFLQDILWEEVTEAPADK

SEQ ID NO: 4462 - protein, 42 aa, synthetic construct
  REGION 1..42: note = Synthetic
KLWEGVKSAIGKRSLRNQDQFDNMFDSDLSDADLKLLDDLFD

SEQ ID NO: 4463 - protein, 13 aa, synthetic construct
  REGION 1..13: note = Synthetic
KRLTKMGGDLNSP

SEQ ID NO: 4464 - protein, 11 aa, synthetic construct
  REGION 1..11: note = Synthetic
GHGGASNYVRL

SEQ ID NO: 4465 - protein, 32 aa, synthetic construct
  REGION 1..32: note = Synthetic
KVPEALQSVAQGLTQGIDDSFSEGIAVYEQFL

SEQ ID NO: 4466 - protein, 23 aa, synthetic construct
  REGION 1..23: note = Synthetic
CQDMLGTFKGWHFCTCYSGRPGC

SEQ ID NO: 4467 - protein, 22 aa, synthetic construct
  REGION 1..22: note = Synthetic
TDYCSRIFAIFNCLRQEILTKS

SEQ ID NO: 4468 - protein, 29 aa, synthetic construct
  REGION 1..29: note = Synthetic
AQEILQRLEEIAEDPGTCEICAYAACTGC

SEQ ID NO: 4469 - protein, 27 aa, synthetic construct
  REGION 1..27: note = Synthetic
QQVLTEIDDAFNNAIAAYGGKYMTEKN

SEQ ID NO: 4470 - protein, 11 aa, synthetic construct
  REGION 1..11: note = Synthetic
EWINGGLEWAE

SEQ ID NO: 4471 - protein, 34 aa, synthetic construct
  REGION 1..34: note = Synthetic
SGYCQWFGRYGNACWCIKLPDKVPIKVPGKCNGR

SEQ ID NO: 4472 - protein, 15 aa, synthetic construct
  REGION 1..15: note = Synthetic
SYYTVIADCCRKPRG

SEQ ID NO: 4473 - protein, 21 aa, synthetic construct
  REGION 1..21: note = Synthetic
AVQKYLAAVLGRRYRQRVRNK

SEQ ID NO: 4474 - protein, 33 aa, synthetic construct
  REGION 1..33: note = Synthetic
KIAEKVASKVAEAADVLKTIVVDSDDGQEHNEL

SEQ ID NO: 4475 - protein, 42 aa, synthetic construct
  REGION 1..42: note = Synthetic
NKASGFIATLCTKVLDFGIDKLIQLIEDKVDANAICAKIHAC

SEQ ID NO: 4476 - protein, 25 aa, synthetic construct
  REGION 1..25: note = Synthetic
GGWKGGGGGGGGWKGGGGGGKGGGG

SEQ ID NO: 4477 - protein, 21 aa, synthetic construct
  REGION 1..21: note = Synthetic
GIVDQCCTSICSLYQLENYCN

SEQ ID NO: 4478 - protein, 21 aa, synthetic construct
  REGION 1..21: note = Synthetic
GIVDQCCTSICSLYQLENYCN

SEQ ID NO: 4479 - protein, 21 aa, synthetic construct
  REGION 1..21: note = Synthetic
GIVDQCCTSICSLYQLENYCN

SEQ ID NO: 4480 - protein, 13 aa, synthetic construct
  REGION 1..13: note = Synthetic
GFQEAYRRFYGTT

SEQ ID NO: 4481 - protein, 28 aa, synthetic construct
  REGION 1..28: note = Synthetic
KFADYVDDCLNRAFSFSAASTGNSVLSL

SEQ ID NO: 4482 - protein, 24 aa, synthetic construct
  REGION 1..24: note = Synthetic
LEKGVQIARQCFCSEKDVIYKKDI

SEQ ID NO: 4483 - protein, 28 aa, synthetic construct
  REGION 1..28: note = Synthetic
MIDECRKLMKSCDYFLLLDADMILKVHP

SEQ ID NO: 4484 - protein, 38 aa, synthetic construct
  REGION 1..38: note = Synthetic
ELLRRLRDIFAAKRNFTRHQQQKATREPESSHSRWRKR

SEQ ID NO: 4485 - protein, 17 aa, synthetic construct
  REGION 1..17: note = Synthetic
ILDVITDAVNSAMNAMG

SEQ ID NO: 4486 - protein, 23 aa, synthetic construct
  REGION 1..23: note = Synthetic
EAFSEVIESAPEAKTDQVTSTVV

SEQ ID NO: 4487 - protein, 19 aa, synthetic construct
  REGION 1..19: note = Synthetic
YGSSYFDYWGQGTTLTVSS

SEQ ID NO: 4488 - protein, 42 aa, synthetic construct
  REGION 1..42: note = Synthetic
NKASGFIATLCTKVLDFGVDKLIQLIEDKVDANAICAKIHAC

SEQ ID NO: 4489 - protein, 18 aa, synthetic construct
  REGION 1..18: note = Synthetic
NVLSSVANGINRALSFFG

SEQ ID NO: 4490 - protein, 12 aa, synthetic construct
  REGION 1..12: note = Synthetic
EYLENWAKEFED

SEQ ID NO: 4491 - protein, 33 aa, synthetic construct
  REGION 1..33: note = Synthetic
YCLNIASTIVSLLTTALIMVFTSATYFLYSVSH

SEQ ID NO: 4492 - protein, 26 aa, synthetic construct
  REGION 1..26: note = Synthetic
YAQCTACCKKAGHNKGTCDFFKCKCT

SEQ ID NO: 4493 - protein, 27 aa, synthetic construct
  REGION 1..27: note = Synthetic
YLKSLYGGYGNGNGEFWEEYIDERYDK

SEQ ID NO: 4494 - protein, 12 aa, synthetic construct
  REGION 1..12: note = Synthetic
CSTVEKLMKRGS

SEQ ID NO: 4495 - protein, 21 aa, synthetic construct
  REGION 1..21: note = Synthetic
LRALKGALESLIEEETGQKKI

SEQ ID NO: 4496 - protein, 25 aa, synthetic construct
  REGION 1..25: note = Synthetic
LSVLDKILENIGQSEGSLELTESIF

SEQ ID NO: 4497 - protein, 25 aa, synthetic construct
  REGION 1..25: note = Synthetic
WLAGCPSGWHNCKSSGPLIGACCKQ

SEQ ID NO: 4498 - protein, 20 aa, synthetic construct
  REGION 1..20: note = Synthetic
EIESAVTELVRNVHEQIPDL

SEQ ID NO: 4499 - protein, 32 aa, synthetic construct
  REGION 1..32: note = Synthetic
KASDLMARVLEKDCPPHPVPGMHKCVCLKTCR

SEQ ID NO: 4500 - protein, 33 aa, synthetic construct
  REGION 1..33: note = Synthetic
KQVMEKFSDAVNTLSVRMPIFLDVTQGAERCRI

SEQ ID NO: 4501 - protein, 11 aa, synthetic construct
  REGION 1..11: note = Synthetic
GAPRVLNNAGR

SEQ ID NO: 4502 - protein, 21 aa, synthetic construct
  REGION 1..21: note = Synthetic
NCDKVAAECFARNTYHPNNKH

SEQ ID NO: 4503 - protein, 15 aa, synthetic construct
  REGION 1..15: note = Synthetic
CQSVAAACARSCGGC

SEQ ID NO: 4504 - protein, 27 aa, synthetic construct
  REGION 1..27: note = Synthetic
RKANNLADTLARQARINNSPMVVSWIN

SEQ ID NO: 4505 - protein, 15 aa, synthetic construct
  REGION 1..15: note = Synthetic
LLREASYILENLEHL

SEQ ID NO: 4506 - protein, 15 aa, synthetic construct
  REGION 1..15: note = Synthetic
KNADELMNEAITHLK

SEQ ID NO: 4507 - protein, 35 aa, synthetic construct
  REGION 1..35: note = Synthetic
YFKNCVKNILKDCQTSKIPFDNCRDNLHIDFTKQQ

SEQ ID NO: 4508 - protein, 33 aa, synthetic construct
  REGION 1..33: note = Synthetic
NILSSIMGSLGTIGNVVGNVCCSITKSCCASEE

SEQ ID NO: 4509 - protein, 33 aa, synthetic construct; identical to SEQ ID NO: 4508
  REGION 1..33: note = Synthetic

SEQ ID NO: 4510 - protein, 35 aa, synthetic construct
  REGION 1..35: note = Synthetic
ITAVVDVIRELGICPDDWAVIPIKANRFSITKSLP

SEQ ID NO: 4511 - protein, 21 aa, synthetic construct
  REGION 1..21: note = Synthetic
GMAALMEELRGLGQGIQGQQY

SEQ ID NO: 4512 - protein, 22 aa, synthetic construct
  REGION 1..22: note = Synthetic
AAAESAWTAGLDNIFGLLFAAL

SEQ ID NO: 4513 - protein, 34 aa, synthetic construct
  REGION 1..34: note = Synthetic
ENIVRTVVEFLTYLHLKEAGALDNLPSPEETNES

SEQ ID NO: 4514 - protein, 26 aa, synthetic construct
  REGION 1..26: note = Synthetic
GNYIDNVYGDLEEQKPDFDSKLELPN

SEQ ID NO: 4515 - protein, 22 aa, synthetic construct
  REGION 1..22: note = Synthetic
QQIFNFATSLIRTIYAKLTSFF

SEQ ID NO: 4516 - protein, 38 aa, synthetic construct
  REGION 1..38: note = Synthetic
GCTTCCTGYKGCYYFGKDGKFVCEGESDEPKANMYPVM

SEQ ID NO: 4517 - protein, 40 aa, synthetic construct
  REGION 1..40: note = Synthetic
AGILTMGRRAGAELEPYPCPGRRCPTATATALAPRGGSRV

SEQ ID NO: 4518 - protein, 14 aa, synthetic construct
  REGION 1..14: note = Synthetic
EWVQKYVSDLELSA

SEQ ID NO: 4519 - protein, 35 aa, synthetic construct
  REGION 1..35: note = Synthetic
RTFRSCARTAFRTAKLRRGEKVGATSADAESDETR

SEQ ID NO: 4520 - protein, 17 aa, synthetic construct
  REGION 1..17: note = Synthetic
GYNAAYNRYFRKRRGAE

SEQ ID NO: 4521 - protein, 36 aa, synthetic construct
  REGION 1..36: note = Synthetic
ECDRVATTCFRDNKDTYDIKYWFYGAKNCQEKSEPC

SEQ ID NO: 4522 - protein, 31 aa, synthetic construct
  REGION 1..31: note = Synthetic
VCNGCGDQVAACEAECFRNDVYTACHEAQKG

SEQ ID NO: 4523 - protein, 29 aa, synthetic construct
  REGION 1..29: note = Synthetic
ASSCFNNVNDVLRRDVEVVEYLNDLMDTF

SEQ ID NO: 4524 - protein, 23 aa, synthetic construct
  REGION 1..23: note = Synthetic
HAFEFMQRALQDLKKTACNLDTR

SEQ ID NO: 4525 - protein, 21 aa, synthetic construct
  REGION 1..21: note = Synthetic
QLAQYYSDLYQYITFVTRPRF

SEQ ID NO: 4526 - protein, 36 aa, synthetic construct
  REGION 1..36: note = Synthetic
NEGPKWANTYCAAVCHMSGRGAGSCNAKDECVCSMT

SEQ ID NO: 4527 - protein, 21 aa, synthetic construct
  REGION 1..21: note = Synthetic
GIVEQCCTGICSLYQLENYCN

SEQ ID NO: 4528 - protein, 15 aa, synthetic construct
  REGION 1..15: note = Synthetic
IAAAKAAGQAALGAL

SEQ ID NO: 4529 - protein, 15 aa, synthetic construct
  REGION 1..15: note = Synthetic
IAAAKAAGQAALGAL

SEQ ID NO: 4530 - protein, 15 aa, synthetic construct
  REGION 1..15: note = Synthetic
IAAAKAAGQAALGAL

SEQ ID NO: 4531 - protein, 15 aa, synthetic construct
  REGION 1..15: note = Synthetic
VLSLMSTWFTQLLRV

SEQ ID NO: 4532 - protein, 25 aa, synthetic construct
  REGION 1..25: note = Synthetic
AGHDLSEWLKGCSVRLKTDSSYNNW

SEQ ID NO: 4533 - protein, 25 aa, synthetic construct
  REGION 1..25: note = Synthetic
RSVLTALERAFDEMKSDPNAMALVT

SEQ ID NO: 4534 - protein, 21 aa, synthetic construct
  REGION 1..21: note = Synthetic
GIVEQCCTSICSLYQLENYCN

SEQ ID NO: 4535 - protein, 21 aa, synthetic construct
  REGION 1..21: note = Synthetic
GIVEQCCTSICSLYQLENYCN

SEQ ID NO: 4536 - protein, 21 aa, synthetic construct
  REGION 1..21: note = Synthetic
GIVEQCCTSICSLYQLENYCN

SEQ ID NO: 4537 - protein, 21 aa, synthetic construct
  REGION 1..21: note = Synthetic
GIVEQCCTSICSLYQLENYCN

SEQ ID NO: 4538 - protein, 21 aa, synthetic construct
  REGION 1..21: note = Synthetic
GIVEQCCTSICSLYQLENYCN

SEQ ID NO: 4539 - protein, 21 aa, synthetic construct
  REGION 1..21: note = Synthetic
GIVEQCCTSICSLYQLENYCN

SEQ ID NO: 4540 - protein, 21 aa, synthetic construct
  REGION 1..21: note = Synthetic
GIVEQCCTSICSLYQLENYCN

SEQ ID NO: 4541 - protein, 21 aa, synthetic construct
  REGION 1..21: note = Synthetic
GIVEQCCTSICSLYQLENYCN

SEQ ID NO: 4542 - protein, 21 aa, synthetic construct
  REGION 1..21: note = Synthetic
GIVEQCCTSICSLYQLENYCN

SEQ ID NO: 4543 - protein, 21 aa, synthetic construct
  REGION 1..21: note = Synthetic
GIVEQCCTSICSLYQLENYCN

SEQ ID NO: 4544 - protein, 29 aa, synthetic construct
  REGION 1..29: note = Synthetic
AQEILQRLEEIADDPGTCEICAYAACTGC

SEQ ID NO: 4545 - protein, 12 aa, synthetic construct
  REGION 1..12: note = Synthetic
VAASCARSCGGC

SEQ ID NO: 4546 - protein, 24 aa, synthetic construct
  REGION 1..24: note = Synthetic
WFDRMKQFIEDFLHCFTPLHDIDL

SEQ ID NO: 4547 - protein, 22 aa, synthetic construct
  REGION 1..22: note = Synthetic
LEKYRAALEGLLSEMLPQHAAK

SEQ ID NO: 4548 - protein, 13 aa, synthetic construct
  REGION 1..13: note = Synthetic
KRLTKMGGDLNSP

SEQ ID NO: 4549 - protein, 28 aa, synthetic construct
  REGION 1..28: note = Synthetic
GLWSKIKDVAAAAGKAALGAVNEALGEQ

SEQ ID NO: 4550 - protein, 21 aa, synthetic construct
  REGION 1..21: note = Synthetic
NVTSFLYDALDTLNDPTTTSL

SEQ ID NO: 4551 - protein, 35 aa, synthetic construct
  REGION 1..35: note = Synthetic
SDAAKEVEDLASEIADELGDDVDVDDDAQTTEKTE

SEQ ID NO: 4552 - protein, 17 aa, synthetic construct
  REGION 1..17: note = Synthetic
GGDCIGGLDGIYCCCLA

SEQ ID NO: 4553 - protein, 19 aa, synthetic construct
  REGION 1..19: note = Synthetic
SLGESLESGISKRISINQD

SEQ ID NO: 4554 - protein, 30 aa, synthetic construct
  REGION 1..30: note = Synthetic
ASSCFNNVNDILRQDVEVVEYLNDLMDTFR

SEQ ID NO: 4555 - protein, 40 aa, synthetic construct
  REGION 1..40: note = Synthetic
EAVADAWHWLNLRPGQPMYKREANADAWHWLQLKPGQPMY

SEQ ID NO: 4556 - protein, 42 aa, synthetic construct
  REGION 1..42: note = Synthetic
CLKSAANAIKGIDLNKAAGIPSVCKVNIPYKISPSTDCSTVQ

SEQ ID NO: 4557 - protein, 42 aa, synthetic construct; identical to SEQ ID NO: 4556
  REGION 1..42: note = Synthetic

SEQ ID NO: 4558 - protein, 16 aa, synthetic construct
  REGION 1..16: note = Synthetic
GNTYCGHFHGYIPSCL

SEQ ID NO: 4559 - protein, 31 aa, synthetic construct
  REGION 1..31: note = Synthetic
VCNNCGDQVAACEAECFRNDVYTACHEAQKG

SEQ ID NO: 4560 - protein, 19 aa, synthetic construct
  REGION 1..19: note = Synthetic
RIRKYFTGYCSGDTCHCSG

SEQ ID NO: 4561 - protein, 25 aa, synthetic construct
  REGION 1..25: note = Synthetic
KGFLSGLLNVAGSVCCKVDTSCCSN

SEQ ID NO: 4562 - protein, 26 aa, synthetic construct
  REGION 1..26: note = Synthetic
KGFLSGLLNVAGSVCCKVDTSCCSSQ

SEQ ID NO: 4563 - protein, 25 aa, synthetic construct
  REGION 1..25: note = Synthetic
KGFLSGLLNVAGSVCCKVDTSCCSN

SEQ ID NO: 4564 - protein, 23 aa, synthetic construct
  REGION 1..23: note = Synthetic
KGFLSGLLNVAGSVCCKVDTSCC

SEQ ID NO: 4565 - protein, 26 aa, synthetic construct
  REGION 1..26: note = Synthetic
KGFLSGLLNVAGSVCCKVDTSCCSNQ

SEQ ID NO: 4566 - protein, 16 aa, synthetic construct
  REGION 1..16: note = Synthetic
ENLIDELNQALKDLGL

SEQ ID NO: 4567 - protein, 22 aa, synthetic construct
  REGION 1..22: note = Synthetic
YCVHSMIDDVDYAVCKKIRVLI

SEQ ID NO: 4568 - protein, 33 aa, synthetic construct
  REGION 1..33: note = Synthetic
KIAEKIASKVGEAADVVKTLIQDTDDVQEHNEL

SEQ ID NO: 4569 - protein, 14 aa, synthetic construct
  REGION 1..14: note = Synthetic
LLDVVGNVLHSLGL

SEQ ID NO: 4570 - protein, 29 aa, synthetic construct
  REGION 1..29: note = Synthetic
ENCRTIIDNLMTLARSFAFSLPYSDYIFY

SEQ ID NO: 4571 - protein, 13 aa, synthetic construct
  REGION 1..13: note = Synthetic
SCLEYGHSCWGAH

SEQ ID NO: 4572 - protein, 11 aa, synthetic construct
  REGION 1..11: note = Synthetic
EWLQGGLEWAE

SEQ ID NO: 4573 - protein, 18 aa, synthetic construct
  REGION 1..18: note = Synthetic
ATGFFEELGSKLAGLFTG

SEQ ID NO: 4574 - protein, 17 aa, synthetic construct
  REGION 1..17: note = Synthetic
FTNCVKDLEEAEKEPPE

SEQ ID NO: 4575 - protein, 32 aa, synthetic construct
  REGION 1..32: note = Synthetic
KDAANKAKDAANKAKDAVVDKTQDFMKSEKLN

SEQ ID NO: 4576 - protein, 18 aa, synthetic construct
  REGION 1..18: note = Synthetic
QMEALVQKLMEKTRSISN

SEQ ID NO: 4577 - protein, 33 aa, synthetic construct
  REGION 1..33: note = Synthetic
KVVEKVASVAKQAAEVVETIIADTDDTQEHNEL

SEQ ID NO: 4578 - protein, 33 aa, synthetic construct; identical to SEQ ID NO: 4577
  REGION 1..33: note = Synthetic

SEQ ID NO: 4579 - protein, 33 aa, synthetic construct; identical to SEQ ID NO: 4577
  REGION 1..33: note = Synthetic

SEQ ID NO: 4580 - protein, 33 aa, synthetic construct
  REGION 1..33: note = Synthetic
NIVDKMASKVAEAAEVVKTIVVDTDDGQEHNEL

SEQ ID NO: 4581 - protein, 23 aa, synthetic construct
  REGION 1..23: note = Synthetic
CERFSNALENLDKLLGVGAGEQF

SEQ ID NO: 4582 - protein, 29 aa, synthetic construct
  REGION 1..29: note = Synthetic
AQEILQRLEEIAEDPSTCEICAYAACTGC

SEQ ID NO: 4583 - protein, 16 aa, synthetic construct
  REGION 1..16: note = Synthetic
VGDDVTTLLTRGEALC

SEQ ID NO: 4584 - protein, 35 aa, synthetic construct
  REGION 1..35: note = Synthetic
GSDIIENAVEFILRSMTRSTEFLEHGDKQGEHSSK

SEQ ID NO: 4585 - protein, 33 aa, synthetic construct
  REGION 1..33: note = Synthetic
NVAEKIAEKVGEAAEVIGTIVADSDDGQEHNEL

SEQ ID NO: 4586 - protein, 30 aa, synthetic construct
  REGION 1..30: note = Synthetic
FRDGCESVLNQVTCEYEFYRLDDLSKRCDA

SEQ ID NO: 4587 - protein, 25 aa, synthetic construct
  REGION 1..25: note = Synthetic
QAIEALGSSGGRPSKIAKITDIGLL

SEQ ID NO: 4588 - protein, 25 aa, synthetic construct
  REGION 1..25: note = Synthetic
TGAETLAEEANTLAEALLEEEMMDN

SEQ ID NO: 4589 - protein, 29 aa, synthetic construct
  REGION 1..29: note = Synthetic
ASSCFNNVNDILRQDVEVVEYLNDLMDTF

SEQ ID NO: 4590 - protein, 41 aa, synthetic construct
  REGION 1..41: note = Synthetic
AGATAGLTPVAQRLRRDTHFPICIFCCGCCRKAICGMCCKT

SEQ ID NO: 4591 - protein, 15 aa, synthetic construct
  REGION 1..15: note = Synthetic
IKSGVEKLKNFLQRG

SEQ ID NO: 4592 - protein, 17 aa, synthetic construct
  REGION 1..17: note = Synthetic
YKNCVKDLEEAGKETEE

SEQ ID NO: 4593 - protein, 18 aa, synthetic construct
  REGION 1..18: note = Synthetic
GCATGYLRTADGRCKPTF

SEQ ID NO: 4594 - protein, 42 aa, synthetic construct
  REGION 1..42: note = Synthetic
LSQLCEELSDCANDIECRGDKKCCFSRCAMRYLEPILESTPQ

SEQ ID NO: 4595 - protein, 17 aa, synthetic construct
  REGION 1..17: note = Synthetic
GYNAAYDRYFRQRRGAK

SEQ ID NO: 4596 - protein, 29 aa, synthetic construct
  REGION 1..29: note = Synthetic
AQEMLQRLEEIAEDPSTCEICAYAACTGC

SEQ ID NO: 4597 - protein, 17 aa, synthetic construct
  REGION 1..17: note = Synthetic
RAAYVVDSCLQQCEDKK

SEQ ID NO: 4598 - protein, 17 aa, synthetic construct
  REGION 1..17: note = Synthetic
RAAYVVDSCLQQCEDKK

SEQ ID NO: 4599 - protein, 14 aa, synthetic construct
  REGION 1..14: note = Synthetic
LAEKAPEFARELAN

SEQ ID NO: 4600 - protein, 21 aa, synthetic construct
  REGION 1..21: note = Synthetic
LRDLKGALESLMEEETGQKKI

SEQ ID NO: 4601 - protein, 34 aa, synthetic construct
  REGION 1..34: note = Synthetic
LETIEDLCERAYSAFQCLREDYEMYQNNNNATSE

SEQ ID NO: 4602 - protein, 22 aa, synthetic construct
  REGION 1..22: note = Synthetic
EDVSTAVQNLQKALKLLTTGRE

SEQ ID NO: 4603 - protein, 27 aa, synthetic construct
  REGION 1..27: note = Synthetic
EGGGSDVDGLMDMDYNSANKKRPIHNR

SEQ ID NO: 4604 - protein, 18 aa, synthetic construct
  REGION 1..18: note = Synthetic
GAAQGLVNKASCKLSGQC

SEQ ID NO: 4605 - protein, 42 aa, synthetic construct
  REGION 1..42: note = Synthetic
CLKSAATSIKGINYGKAASLPRQCGVSVPYAISPNTNCNAIH

SEQ ID NO: 4606 - protein, 27 aa, synthetic construct
  REGION 1..27: note = Synthetic
SSIFKTLRTIANDDCELCVNVACTGCL

SEQ ID NO: 4607 - protein, 24 aa, synthetic construct
  REGION 1..24: note = Synthetic
KTAADAAAKAAAKAAAIAAAAASA

SEQ ID NO: 4608 - protein, 15 aa, synthetic construct
  REGION 1..15: note = Synthetic
FLDKVVAYMQTMKQA

SEQ ID NO: 4609 - protein, 23 aa, synthetic construct
  REGION 1..23: note = Synthetic
WSKIKEAAKTAGLMAMGFVNDMV

SEQ ID NO: 4610 - protein, 23 aa, synthetic construct
  REGION 1..23: note = Synthetic
NNMAKSINSGGELIRALDEEEVF

SEQ ID NO: 4611 - protein, 12 aa, synthetic construct
  REGION 1..12: note = Synthetic
LVAFVSAVVALF

SEQ ID NO: 4612 - protein, 41 aa, synthetic construct
  REGION 1..41: note = Synthetic
LQSVGRLASSLRLVNITLGSGTGLIRVGLAPTGFILNLNIN

SEQ ID NO: 4613 - protein, 38 aa, synthetic construct
  REGION 1..38: note = Synthetic
GCTTCCTGYKGCYYFGKNGKFVCEGESDEPKANMYPAM

SEQ ID NO: 4614 - protein, 17 aa, synthetic construct
  REGION 1..17: note = Synthetic
SVLDLCYSIFNSMHKNE

SEQ ID NO: 4615 - protein, 35 aa, synthetic construct
  REGION 1..35: note = Synthetic
TAARTVAKEVLTVVSLGWEMFCPYMSLDLARDRGR

SEQ ID NO: 4616 - protein, 29 aa, synthetic construct
  REGION 1..29: note = Synthetic
AQEILQRLEEIAEDPSTCEICAYAACTGC

SEQ ID NO: 4617 - protein, 29 aa, synthetic construct
  REGION 1..29: note = Synthetic
AQEILQRLEEIAEDPSTCEICAYAACTGC

SEQ ID NO: 4618 - protein, 29 aa, synthetic construct
  REGION 1..29: note = Synthetic
AQEILQRLEEIAEDPSTCEICAYAACTGC

SEQ ID NO: 4619 - protein, 22 aa, synthetic construct
  REGION 1..22: note = Synthetic
EGWEKCASYYTVIADCCRRPRS

SEQ ID NO: 4620 - protein, 17 aa, synthetic construct
  REGION 1..17: note = Synthetic
GYNAAYNRYFRQRRGAK

SEQ ID NO: 4621 - protein, 11 aa, synthetic construct
  REGION 1..11: note = Synthetic
LKALLSRYAGY

SEQ ID NO: 4622 - protein, 37 aa, synthetic construct
  REGION 1..37: note = Synthetic
IAAVVDIIRELGICPNDAAVTPISKNRFYTIKTLVVA

SEQ ID NO: 4623 - protein, 16 aa, synthetic construct
  REGION 1..16: note = Synthetic
FFTAYLQYMRSGNSFY

SEQ ID NO: 4624 - protein, 12 aa, synthetic construct
  REGION 1..12: note = Synthetic
GLSEALERAGRR

SEQ ID NO: 4625 - protein, 12 aa, synthetic construct
  REGION 1..12: note = Synthetic
MATNCAKACNSC

SEQ ID NO: 4626 - protein, 20 aa, synthetic construct
  REGION 1..20: note = Synthetic
GIESLYTGIVGGIVLILGLL

SEQ ID NO: 4627 - protein, 28 aa, synthetic construct
  REGION 1..28: note = Synthetic
ASSIFKTLRTIANDDCELCVNVACTGCL

SEQ ID NO: 4628 - protein, 27 aa, synthetic construct
  REGION 1..27: note = Synthetic
DELHKWVEEAIDMLQLTSSEDHHLTLR

SEQ ID NO: 4629 - protein, 19 aa, synthetic construct
  REGION 1..19: note = Synthetic
HQCPTGLSACIEGKCICLP

SEQ ID NO: 4630 - protein, 17 aa, synthetic construct
  REGION 1..17: note = Synthetic
FQHCVKDLEEAKKEPPE

SEQ ID NO: 4631 - protein, 22 aa, synthetic construct
  REGION 1..22: note = Synthetic
DRAEKVAEDLLRALRMQYEDES

SEQ ID NO: 4632 - protein, 23 aa, synthetic construct
  REGION 1..23: note = Synthetic
LEKYRAALEGLLSEVLLPARNDK

SEQ ID NO: 4633 - protein, 34 aa, synthetic construct
  REGION 1..34: note = Synthetic
GPGGECGGRFGGCAGGQCCSRFGFCGSGPKYCAH

SEQ ID NO: 4634 - protein, 20 aa, synthetic construct
  REGION 1..20: note = Synthetic
DIQKCCKNGCGHMSCTRPST

SEQ ID NO: 4635 - protein, 41 aa, synthetic construct
  REGION 1..41: note = Synthetic
MSGFKGYLSTVPVVFAIWLTFTAGLIIEINRLFPDGLVFSF

SEQ ID NO: 4636 - protein, 27 aa, synthetic construct
  REGION 1..27: note = Synthetic
AEAGTQVIHAGGHTLIQTDRSQYIRKN

SEQ ID NO: 4637 - protein, 27 aa, synthetic construct
  REGION 1..27: note = Synthetic
WVSSCLTIADEVADSLRSGDIGPFHVG

SEQ ID NO: 4638 - protein, 18 aa, synthetic construct
  REGION 1..18: note = Synthetic
ATGFFEELGSKLAGLFTG

SEQ ID NO: 4639 - protein, 25 aa, synthetic construct
  REGION 1..25: note = Synthetic
NQLLHLAEDLARRLLPAFDTPTGIP

SEQ ID NO: 4640 - protein, 13 aa, synthetic construct
  REGION 1..13: note = Synthetic
GFQEAYRRFYGTT

SEQ ID NO: 4641 - protein, 13 aa, synthetic construct
  REGION 1..13: note = Synthetic
GFQEAYRRFYGTT

SEQ ID NO: 4642 - protein, 13 aa, synthetic construct
  REGION 1..13: note = Synthetic
GFQEAYRRFYGTT

SEQ ID NO: 4643 - protein, 35 aa, synthetic construct
  REGION 1..35: note = Synthetic
KCAKKIARDAHGLTPWYGWKNHCEGRDLSSYVKGC

SEQ ID NO: 4644 - protein, 34 aa, synthetic construct
  REGION 1..34: note = Synthetic
NALKEAIKGVQNAVITINEHLEEVRYEIAALETE

SEQ ID NO: 4645 - protein, 20 aa, synthetic construct
  REGION 1..20: note = Synthetic
RGCQRCCSYAGEAVEVETHA

SEQ ID NO: 4646 - protein, 13 aa, synthetic construct
  REGION 1..13: note = Synthetic
VGSIIGDLIQGAK

SEQ ID NO: 4647 - protein, 15 aa, synthetic construct
  REGION 1..15: note = Synthetic
QCCNAFCDTATRTCV

SEQ ID NO: 4648 - protein, 14 aa, synthetic construct
  REGION 1..14: note = Synthetic
ILGLVSNALGGLLG

SEQ ID NO: 4649 - protein, 29 aa, synthetic construct
  REGION 1..29: note = Synthetic
AQEILQRLEEIAEDPGTCEICAYAACTGC

SEQ ID NO: 4650 - protein, 29 aa, synthetic construct
  REGION 1..29: note = Synthetic
AQEILQRLEEIAEDPGTCEICAYAACTGC

SEQ ID NO: 4651 - protein, 31 aa, synthetic construct
  REGION 1..31: note = Synthetic
GKRYIRGCADTCPVRKPREIVECCSTDKCNH

SEQ ID NO: 4652 - protein, 31 aa, synthetic construct; identical to SEQ ID NO: 4651
  REGION 1..31: note = Synthetic

SEQ ID NO: 4653 - protein, 42 aa, synthetic construct
  REGION 1..42: note = Synthetic
GKASGFLGTLCEKILSFGVDELVKLIENHVDPVVVCEKIHAC

SEQ ID NO: 4654 - protein, 19 aa, synthetic construct
  REGION 1..19: note = Synthetic
KQMEAIIKKLTDQTMAIEN

SEQ ID NO: 4655 - protein, 36 aa, synthetic construct
  REGION 1..36: note = Synthetic
ATLPNYCRAGGNGPKDFVCQGVADAYITLVTLPKSS

SEQ ID NO: 4656 - protein, 30 aa, synthetic construct
  REGION 1..30: note = Synthetic
KFVSDVADYFWEMAKISGKVVGNGIASQNE

SEQ ID NO: 4657 - protein, 27 aa, synthetic construct
  REGION 1..27: note = Synthetic
VLEYVVHFLSSLWDTKEEHRHENQTSY

SEQ ID NO: 4658 - protein, 37 aa, synthetic construct
  REGION 1..37: note = Synthetic
HDAHTCLSALPERNSTNYFVQPCCCLRLLGLTGLLSK

SEQ ID NO: 4659 - protein, 17 aa, synthetic construct
  REGION 1..17: note = Synthetic
TVLDLCYSIFNNMHKNE

SEQ ID NO: 4660 - protein, 29 aa, synthetic construct
  REGION 1..29: note = Synthetic
QFVEIINNVINDAINNREIDESLPQYSET

SEQ ID NO: 4661 - protein, 38 aa, synthetic construct
  REGION 1..38: note = Synthetic
VGKRGLRNLDDLDDLDLDHLFDSDVSDADLRLLKQMFR

SEQ ID NO: 4662 - protein, 13 aa, synthetic construct
  REGION 1..13: note = Synthetic
QYSRLGENWARNK

SEQ ID NO: 4663 - protein, 34 aa, synthetic construct; identical to SEQ ID NO: 4601
  REGION 1..34: note = Synthetic

SEQ ID NO: 4664 - protein, 22 aa, synthetic construct
  REGION 1..22: note = Synthetic
CRSGGAGAGSMICLCDYCSDKP

SEQ ID NO: 4665 - protein, 32 aa, synthetic construct
  REGION 1..32: note = Synthetic
LEDFQNAVRAGGLNPDNIFIPKQSETCPLGSN

SEQ ID NO: 4666 - protein, 24 aa, synthetic construct
  REGION 1..24: note = Synthetic
FFKSCVELLNKGYDEKDENVKPEW

SEQ ID NO: 4667 - protein, 39 aa, synthetic construct
  REGION 1..39: note = Synthetic
LKGLPTCGETCFGGTCNTPGCTCDPWPICTRDGLPSAAA

SEQ ID NO: 4668 - protein, 13 aa, synthetic construct
  REGION 1..13: note = Synthetic
IYEWLQGGLDWAE

SEQ ID NO: 4669 - protein, 34 aa, synthetic construct
  REGION 1..34: note = Synthetic
NVKEVLENGGTTLSKKTILLLVTPFLAAAWSRHP

SEQ ID NO: 4670 - protein, 42 aa, synthetic construct
  REGION 1..42: note = Synthetic
CKGGNNACAAAVCDCDRLAAICFAGAPYNDNNYNIDLKARCQ

SEQ ID NO: 4671 - protein, 42 aa, synthetic construct; identical to SEQ ID NO: 4670
  REGION 1..42: note = Synthetic

SEQ ID NO: 4672 - protein, 22 aa, synthetic construct
  REGION 1..22: note = Synthetic
CKSCGTSCAGSCTSCSCGSCSH

SEQ ID NO: 4673 - protein, 21 aa, synthetic construct
  REGION 1..21: note = Synthetic
LYTAFGQPAQQLRDPFEEHGD

SEQ ID NO: 4674 - protein, 14 aa, synthetic construct
  REGION 1..14: note = Synthetic
VEIASEGFKRAIES

SEQ ID NO: 4675 - protein, 13 aa, synthetic construct
  REGION 1..13: note = Synthetic
GQDLSSYVAGCGV

SEQ ID NO: 4676 - protein, 29 aa, synthetic construct
  REGION 1..29: note = Synthetic
ASSCFNNVNDVLRQDVEVVEYLNDLMDTF

SEQ ID NO: 4677 - protein, 29 aa, synthetic construct
  REGION 1..29: note = Synthetic
ASSCFNNVNDVLRQDVEVVEYLNDLMDTF

SEQ ID NO: 4678 - protein, 36 aa, synthetic construct
  REGION 1..36: note = Synthetic
ECDRVAATCFRDNKDTYDMKYWLYGAKNCQEESEPC

SEQ ID NO: 4679 - protein, 22 aa, synthetic construct
  REGION 1..22: note = Synthetic
EGWEKCASYYTVVADCCRRPRS

SEQ ID NO: 4680 - protein, 37 aa, synthetic construct
  REGION 1..37: note = Synthetic
IAAVVDVIRELGICPDDAAVIPIKNNRFYTIEILKVE

SEQ ID NO: 4681 - protein, 26 aa, synthetic construct
  REGION 1..26: note = Synthetic
RQYAAQLPSMCRVEPQQCSIFAAGQY

SEQ ID NO: 4682 - protein, 15 aa, synthetic construct
  REGION 1..15: note = Synthetic
EQVADDVKELASDVI

SEQ ID NO: 4683 - protein, 34 aa, synthetic construct
  REGION 1..34: note = Synthetic
KDLCNGVAGAGHSPWALAGGLLLSLGPALLWAGP

SEQ ID NO: 4684 - protein, 42 aa, synthetic construct
  REGION 1..42: note = Synthetic
SPGSRVFKSGDDRITLSRGTNYFICSVPGHCQGGLKIAVTAA

SEQ ID NO: 4685 - protein, 15 aa, synthetic construct
  REGION 1..15: note = Synthetic
DGLRGLTQGIQDQQY

SEQ ID NO: 4686 - protein, 27 aa, synthetic construct
  REGION 1..27: note = Synthetic
WVSSCLTVADELASSLRTGDIGPFHVG

SEQ ID NO: 4687 - protein, 26 aa, synthetic construct
  REGION 1..26: note = Synthetic
DPFEKAANHMREALKFENLKGREVKS

SEQ ID NO: 4688 - protein, 34 aa, synthetic construct
  REGION 1..34: note = Synthetic
GWMDGWMDGWMDGWMDGWMDGWMGGLGRSEGIRD

SEQ ID NO: 4689 - protein, 41 aa, synthetic construct
  REGION 1..41: note = Synthetic
GICDTYLECGGLACSDYRRACCVNGKCVCRKQGQTLPDCPN

SEQ ID NO: 4690 - protein, 14 aa, synthetic construct
  REGION 1..14: note = Synthetic
VEIASEGFKRAIES

SEQ ID NO: 4691 - protein, 33 aa, synthetic construct
  REGION 1..33: note = Synthetic
ELLDKFQQFAKEQGLTDDNILILPQTDSCMSEV

SEQ ID NO: 4692 - protein, 16 aa, synthetic construct
  REGION 1..16: note = Synthetic
VLELVRGLGRGALRAV

SEQ ID NO: 4693 - protein, 31 aa, synthetic construct; identical to SEQ ID NO: 4522
  REGION 1..31: note = Synthetic

SEQ ID NO: 4694 - protein, 40 aa, synthetic construct
  REGION 1..40: note = Synthetic
DKAIRTIMEFLAFLHLKEAGALGRLPGLPSAASSEDAGQS

SEQ ID NO: 4695 - protein, 14 aa, synthetic construct
  REGION 1..14: note = Synthetic
LLGFVGSLLGGLGI

SEQ ID NO: 4696 - protein, 29 aa, synthetic construct
  REGION 1..29: note = Synthetic
ASSCFNNVNDILRQDVEVVEYLNDLMDTF

SEQ ID NO: 4697 - protein, 27 aa, synthetic construct
  REGION 1..27: note = Synthetic
YLKSLYGGYGNGNGEFWEEYIDERYDN

SEQ ID NO: 4698 - protein, 35 aa, synthetic construct
  REGION 1..35: note = Synthetic
DLVTKFLNNAFTAAQAAQTSKGTLESLQYYFIVRI

SEQ ID NO: 4699 - protein, 35 aa, synthetic construct; identical to SEQ ID NO: 4698
  REGION 1..35: note = Synthetic

SEQ ID NO: 4700 - protein, 27 aa, synthetic construct
  REGION 1..27: note = Synthetic
EDIPECVKQWISTLSLHECSDVTNSCL

SEQ ID NO: 4701 - protein, 27 aa, synthetic construct
  REGION 1..27: note = Synthetic
EDIPECVKQWISTLSLHECSDVTNSCL

SEQ ID NO: 4702 - protein, 14 aa, synthetic construct
  REGION 1..14: note = Synthetic
GAVKSLLGVLTMFG

SEQ ID NO: 4703 - protein, 38 aa, synthetic construct
  REGION 1..38: note = Synthetic
HSGSQVGKALLGIQSANRTDGPGRKRRSFDLYALVNAK

SEQ ID NO: 4704 - protein, 34 aa, synthetic construct
  REGION 1..34: note = Synthetic
SGYCQWAGKYGNACWCYALPDNVPIRVPGKCHRK

SEQ ID NO: 4705 - protein, 14 aa, synthetic construct
  REGION 1..14: note = Synthetic
LLGMVGSLLGGLGL

SEQ ID NO: 4706 - protein, 24 aa, synthetic construct
  REGION 1..24: note = Synthetic
ARGCGTSCPGGIRPVCCRTDLSNK

SEQ ID NO: 4707 - protein, 25 aa, synthetic construct
  REGION 1..25: note = Synthetic
KRAASEVSEFFRNAIDADFNHFDPG

SEQ ID NO: 4708 - protein, 35 aa, synthetic construct
  REGION 1..35: note = Synthetic
GTEIIENAVEFILRSMSRSTGFMEFDDNEGKHSSK

SEQ ID NO: 4709 - protein, 24 aa, synthetic construct
  REGION 1..24: note = Synthetic
NCDRVAANCFAKAPYNKRNYNNCK

SEQ ID NO: 4710 - protein, 17 aa, synthetic construct
  REGION 1..17: note = Synthetic
LLSKAGAVLSNGDNVQF

SEQ ID NO: 4711 - protein, 16 aa, synthetic construct
  REGION 1..16: note = Synthetic
GTHIWNEIRGWSHWSG

SEQ ID NO: 4712 - protein, 16 aa, synthetic construct
  REGION 1..16: note = Synthetic
GTHIWNEIRGWSHWSG

SEQ ID NO: 4713 - protein, 26 aa, synthetic construct
  REGION 1..26: note = Synthetic
LGTCYTQGCTCSWPICKRNGLPDVAA

SEQ ID NO: 4714 - protein, 35 aa, synthetic construct
  REGION 1..35: note = Synthetic
QVSEILKQAIQKFNTHSAEPALFKLVEIKEAKRQV

SEQ ID NO: 4715 - protein, 16 aa, synthetic construct
  REGION 1..16: note = Synthetic
AQYSRLGGNWPRNKRS

SEQ ID NO: 4716 - protein, 26 aa, synthetic construct
  REGION 1..26: note = Synthetic
DNAKSALQHLNQRCCQTFYWCCVQGK

SEQ ID NO: 4717 - protein, 26 aa, synthetic construct
  REGION 1..26: note = Synthetic
DNAKSALQHLNQRCCQTFYWCCGQGK

SEQ ID NO: 4718 - protein, 25 aa, synthetic construct
  REGION 1..25: note = Synthetic
QEANAWGRNGGDPNRYRPPGLPSKY

SEQ ID NO: 4719 - protein, 23 aa, synthetic construct
  REGION 1..23: note = Synthetic
HAFEFMQRALQDLKKTAYNLDTR

SEQ ID NO: 4720 - protein, 23 aa, synthetic construct
  REGION 1..23: note = Synthetic
HAFEFMQRALQDLKKTAYNLDTR

SEQ ID NO: 4721 - protein, 23 aa, synthetic construct
  REGION 1..23: note = Synthetic
HAFEFMQRALQDLKKTAYSLDTR

SEQ ID NO: 4722 - protein, 23 aa, synthetic construct
  REGION 1..23: note = Synthetic
HAFEFMQRALQDLKKTAYNLDTR

SEQ ID NO: 4723 - protein, 23 aa, synthetic construct
  REGION 1..23: note = Synthetic
HAFEFMQRALQDLKKTAYNLDTR

SEQ ID NO: 4724 - protein, 23 aa, synthetic construct
  REGION 1..23: note = Synthetic
HAFEFMQRALQDLKKTAYNLDTR

SEQ ID NO: 4725 - protein, 23 aa, synthetic construct
  REGION 1..23: note = Synthetic
HAFEFMQRALQDLKKTAYNLDTR

SEQ ID NO: 4726 - protein, 23 aa, synthetic construct
  REGION 1..23: note = Synthetic
HAFEFMQRALQDLKKTAYNLDTR

SEQ ID NO: 4727 - protein, 23 aa, synthetic construct
  REGION 1..23: note = Synthetic
HAFEFMQRALQDLKKTAYNLDTR

SEQ ID NO: 4728 - protein, 23 aa, synthetic construct
  REGION 1..23: note = Synthetic
HAFEFMQRALQDLKKTAYNLDTR

SEQ ID NO: 4729 - protein, 23 aa, synthetic construct
  REGION 1..23: note = Synthetic
HAFEFMQRALQDLKKTAYNLDTR

SEQ ID NO: 4730 - protein, 23 aa, synthetic construct
  REGION 1..23: note = Synthetic
HAFEFMQRALQDLKKTAYNLDTR

SEQ ID NO: 4731 - protein, 23 aa, synthetic construct
  REGION 1..23: note = Synthetic
HAFEFMQRALQDLKKTAYNLDTR

SEQ ID NO: 4732 - protein, 13 aa, synthetic construct
  REGION 1..13: note = Synthetic
IYEWLQGGLEWAE

SEQ ID NO: 4733 - protein, 35 aa, synthetic construct
  REGION 1..35: note = Synthetic
VARIIKNLISSIVTAIVTAVTTVLATEGLPGNING

SEQ ID NO: 4734 - protein, 23 aa, synthetic construct
  REGION 1..23: note = Synthetic
IETGFHKWENFYCEQQDPFVCEA

SEQ ID NO: 4735 - protein, 32 aa, synthetic construct
  REGION 1..32: note = Synthetic
LEDFQSVVRAGGLNPDNIFIPKQSETCPLGSN

SEQ ID NO: 4736 - protein, 24 aa, synthetic construct
  REGION 1..24: note = Synthetic
ARGCGTSCPGGIRPVCCRTDLCNK

SEQ ID NO: 4737 - protein, 18 aa, synthetic construct
  REGION 1..18: note = Synthetic
MAELRAIYGGGPVEYVQL

SEQ ID NO: 4738 - protein, 12 aa, synthetic construct
  REGION 1..12: note = Synthetic
VLNSADNLVHGL

SEQ ID NO: 4739 - protein, 27 aa, synthetic construct
  REGION 1..27: note = Synthetic
DLINKCGRGGVGGGGLNGIFLSYEGVV

SEQ ID NO: 4740 - protein, 16 aa, synthetic construct
  REGION 1..16: note = Synthetic
EFGRCLQEIISNASES

SEQ ID NO: 4741 - protein, 34 aa, synthetic construct
  REGION 1..34: note = Synthetic
LNSAATLASSLLSELLACQGWCSFMHTWFSIEHS

SEQ ID NO: 4742 - protein, 16 aa, synthetic construct
  REGION 1..16: note = Synthetic
AVDSIRRMASEATEAP

SEQ ID NO: 4743 - protein, 39 aa, synthetic construct
  REGION 1..39: note = Synthetic
GDLERAAASLPAFCNVDIPNGPGGVCYWLGYPRTPRTGH

SEQ ID NO: 4744 - protein, 27 aa, synthetic construct
  REGION 1..27: note = Synthetic
IATFVTDIFQGAKYFRVKMDIKLYECY

SEQ ID NO: 4745 - protein, 27 aa, synthetic construct
  REGION 1..27: note = Synthetic
IATFVTDIFQGAKYFRVKMDIKLYECY

SEQ ID NO: 4746 - protein, 27 aa, synthetic construct
  REGION 1..27: note = Synthetic
IATFVTDIFQGAKYFRVKMDIKLYECY

SEQ ID NO: 4747 - protein, 39 aa, synthetic construct
  REGION 1..39: note = Synthetic
AQEAWAPVQSALQEAAEKTKEAAANLQNSIQSAVQKPAN

SEQ ID NO: 4748 - protein, 17 aa, synthetic construct
  REGION 1..17: note = Synthetic
QWCTAGCNSITSKCDTL

SEQ ID NO: 4749 - protein, 18 aa, synthetic construct
  REGION 1..18: note = Synthetic
KTLVNLWSKLAQRIFLVS

SEQ ID NO: 4750 - protein, 18 aa, synthetic construct
  REGION 1..18: note = Synthetic
AAWGATLDAFFGMVFAKM

SEQ ID NO: 4751 - protein, 18 aa, synthetic construct
  REGION 1..18: note = Synthetic
GAAKGLLEVASCKLSKSC

SEQ ID NO: 4752 - protein, 38 aa, synthetic construct
  REGION 1..38: note = Synthetic
DKARELISRIKQSELSAKMREWFSETFQKVKEKLKIDS

SEQ ID NO: 4753 - protein, 42 aa, synthetic construct
  REGION 1..42: note = Synthetic
CLKNAAAGVSGLNAGNAASIPSKCGVSIPYTISTSTDCSRVN

SEQ ID NO: 4754 - protein, 33 aa, synthetic construct
  REGION 1..33: note = Synthetic
CGSDGKTYANKCHLMTEACWSPTSITLVHEGKC

SEQ ID NO: 4755 - protein, 21 aa, synthetic construct
  REGION 1..21: note = Synthetic
RSFRNGVGSGVKKTSFRRAKQ

SEQ ID NO: 4756 - protein, 36 aa, synthetic construct
  REGION 1..36: note = Synthetic
ECDRVAATCFRDNKDTYDNKYWFYPAKNCQEESEPC

SEQ ID NO: 4757 - protein, 11 aa, synthetic construct
  REGION 1..11: note = Synthetic
NCVRSYCTLFG

SEQ ID NO: 4758 - protein, 28 aa, synthetic construct
  REGION 1..28: note = Synthetic
DVQEAAKEAVEQFNSKPRAKKYFKLIKI

SEQ ID NO: 4759 - protein, 25 aa, synthetic construct
  REGION 1..25: note = Synthetic
WVGSCASGWHKCNDEYNIAYECCKE

SEQ ID NO: 4760 - protein, 25 aa, synthetic construct
  REGION 1..25: note = Synthetic
WVGSCASGWHKCNDEYNIAYECCKE

SEQ ID NO: 4761 - protein, 23 aa, synthetic construct
  REGION 1..23: note = Synthetic
YGGCGGNANNFKTIEECQRTCAG

SEQ ID NO: 4762 - protein, 20 aa, synthetic construct
  REGION 1..20: note = Synthetic
FVASVAAEMQHVYCAASRKC

SEQ ID NO: 4763 - protein, 17 aa, synthetic construct
  REGION 1..17: note = Synthetic
ERLAYEATSVANNVDDH

SEQ ID NO: 4764 - protein, 27 aa, synthetic construct
  REGION 1..27: note = Synthetic
IPEAIARAVAWLEAHPQAPEPVHHSHH

SEQ ID NO: 4765 - protein, 28 aa, synthetic construct
  REGION 1..28: note = Synthetic
NDCEEAAQELFQQIQEAQADLASKGLIL

SEQ ID NO: 4766 - protein, 39 aa, synthetic construct
  REGION 1..39: note = Synthetic
DKAKKAIERIKQSDLPAKTRNWFTETFGKVRDTFKATFS

SEQ ID NO: 4767 - protein, 37 aa, synthetic construct
  REGION 1..37: note = Synthetic
ISVAATCAKKIYKRHKFDAWYGWKNHCQHGLPDISDC

SEQ ID NO: 4768 - protein, 13 aa, synthetic construct
  REGION 1..13: note = Synthetic
IYEWLQGGLEWAE

SEQ ID NO: 4769 - protein, 40 aa, synthetic construct
  REGION 1..40: note = Synthetic
LEKYRAALEAAERAVHPDAPSRPCWPAGGESGWSGEPSPT

SEQ ID NO: 4770 - protein, 15 aa, synthetic construct
  REGION 1..15: note = Synthetic
EVGEAFRTAVSGAEK

SEQ ID NO: 4771 - protein, 38 aa, synthetic construct
  REGION 1..38: note = Synthetic
VHEICGGVFDGGCYCCPKTPALCWADIQFCTTYCQSQT

SEQ ID NO: 4772 - protein, 26 aa, synthetic construct
  REGION 1..26: note = Synthetic
DNVKRILQTLSNKRSCCPTILSCCFV

SEQ ID NO: 4773 - protein, 27 aa, synthetic construct
  REGION 1..27: note = Synthetic
IATFVTDLFQGARYFRVKMDIKLYECY

SEQ ID NO: 4774 - protein, 28 aa, synthetic construct
  REGION 1..28: note = Synthetic
DEMNTILDNLATRDFINWLIQTKITDRK

SEQ ID NO: 4775 - protein, 34 aa, synthetic construct
  REGION 1..34: note = Synthetic
SGYCQWAGRYGNACWCIDLPDKVPIRIPGPCIGR

SEQ ID NO: 4776 - protein, 23 aa, synthetic construct
  REGION 1..23: note = Synthetic
YGGCGGNANNFKTIDECQRTCAG

SEQ ID NO: 4777 - protein, 36 aa, synthetic construct
  REGION 1..36: note = Synthetic
TCINDFVKKGGVAAKPSSCECDDFGEEHLCRCYVPC

SEQ ID NO: 4778 - protein, 40 aa, synthetic construct
  REGION 1..40: note = Synthetic
NNVVRTIIEFLTFLHLKDAGALERLPSLPTAESAEDAERS

SEQ ID NO: 4779 - protein, 27 aa, synthetic construct
  REGION 1..27: note = Synthetic
IATFVTDLFQGAKYFRVKMDIKLYECY

SEQ ID NO: 4780 - protein, 26 aa, synthetic construct
  REGION 1..26: note = Synthetic
NTVIEEASKVCSKMRRLKGLCKSIMK

SEQ ID NO: 4781 - protein, 19 aa, synthetic construct
  REGION 1..19: note = Synthetic
DIEDVANYILTQAEKGWSN

SEQ ID NO: 4782 - protein, 25 aa, synthetic construct
  REGION 1..25: note = Synthetic
LGNLAEELNGYSRKKGGFSFRFGRR

SEQ ID NO: 4783 - protein, 23 aa, synthetic construct
  REGION 1..23: note = Synthetic
VVALISALVTGILALRLGRELYR

SEQ ID NO: 4784 - protein, 12 aa, synthetic construct
  REGION 1..12: note = Synthetic
GGCHELCQCCEG

SEQ ID NO: 4785 - protein, 28 aa, synthetic construct
  REGION 1..28: note = Synthetic
EKADAVYTGLNTRSQETYETLKHEKPPQ

SEQ ID NO: 4786 - protein, 23 aa, synthetic construct
  REGION 1..23: note = Synthetic
QNAWDKVKTIISEMQLQFSPPNL

SEQ ID NO: 4787 - protein, 39 aa, synthetic construct
  REGION 1..39: note = Synthetic
KLAKRCLESGSLCFAGYGHSSCCSGACLDYGGLGVGACR

SEQ ID NO: 4788 - protein, 24 aa, synthetic construct
  REGION 1..24: note = Synthetic
IYGGCYGNANNFKTIDECKRTCAA

SEQ ID NO: 4789 - protein, 40 aa, synthetic construct
  REGION 1..40: note = Synthetic
AGILTMGRRAGAELEPHPCSGRGCPTVTTTALAPRGGSGV

SEQ ID NO: 4790 - protein, 13 aa, synthetic construct
  REGION 1..13: note = Synthetic
VGAAVGGALAFLI

SEQ ID NO: 4791 - protein, 28 aa, synthetic construct
  REGION 1..28: note = Synthetic
QEADHVADKLCSEVSGLCKGVPVSRGEL

SEQ ID NO: 4792 - protein, 40 aa, synthetic construct
  REGION 1..40: note = Synthetic
QKFLNKIYQYYQTFLWPEYLKTVYQYQKTMTPWNHIKRYF

SEQ ID NO: 4793 - protein, 40 aa, synthetic construct
  REGION 1..40: note = Synthetic
GGGGGGGGARRLKGLAKKRAGNGCFGLKLDRIGSMSGLGC

SEQ ID NO: 4794 - protein, 39 aa, synthetic construct
  REGION 1..39: note = Synthetic
DMAKAALTELKSCIDELQPVHKEQLVKLLVQVLDAQEDT

SEQ ID NO: 4795 - protein, 37 aa, synthetic construct
  REGION 1..37: note = Synthetic
LFRAAPSLLNSASAASMLWAELIAMAPSIPSALPPFS

SEQ ID NO: 4796 - protein, 25 aa, synthetic construct
  REGION 1..25: note = Synthetic
DNFYQSCVDLLNKVYEEKDTPPVQE

SEQ ID NO: 4797 - protein, 36 aa, synthetic construct
  REGION 1..36: note = Synthetic
AEQAVKTGCRSVPGDANAPFPDCCPTTLCRGRQWDH

SEQ ID NO: 4798 - protein, 21 aa, synthetic construct
  REGION 1..21: note = Synthetic
GIVEQCCAGVCSLYQLENYCN

SEQ ID NO: 4799 - protein, 32 aa, synthetic construct
  REGION 1..32: note = Synthetic
SDFKSAISDCGRGDYTGCGVASGKIVGILMRQ

SEQ ID NO: 4800 - protein, 29 aa, synthetic construct
  REGION 1..29: note = Synthetic
ASSCFNNVNDVLRQDVEVVEYLNDLMDTF

SEQ ID NO: 4801 - protein, 32 aa, synthetic construct
  REGION 1..32: note = Synthetic
FMDTAKNVAKNVAKNVAVTLLDKLRCKVTGGC

SEQ ID NO: 4802 - protein, 42 aa, synthetic construct
  REGION 1..42: note = Synthetic
YNQIINTFIDDCLFLQTPMLQSPISSKIVLSFFLRNFFPSLF

SEQ ID NO: 4803 - protein, 21 aa, synthetic construct
  REGION 1..21: note = Synthetic
GIVEQCCASVCSLYQLENYCN

SEQ ID NO: 4804 - protein, 26 aa, synthetic construct
  REGION 1..26: note = Synthetic
ASTVVTYVYQLIEDDVKVERIEFKKY

SEQ ID NO: 4805 - protein, 26 aa, synthetic construct
  REGION 1..26: note = Synthetic
ASTVVTYVYQLIEDDVKVERIEFKKY

SEQ ID NO: 4806 - protein, 14 aa, synthetic construct
  REGION 1..14: note = Synthetic
GFQDAYKRIYGTTV

SEQ ID NO: 4807 - protein, 26 aa, synthetic construct
  REGION 1..26: note = Synthetic
DNFYQSCVDLLNKVYEEKDVPVPPEE

SEQ ID NO: 4808 - protein, 24 aa, synthetic construct
  REGION 1..24: note = Synthetic
LYTFCTFVQTCVSMCVCVCVGSCL

SEQ ID NO: 4809 - protein, 41 aa, synthetic construct
  REGION 1..41: note = Synthetic
VNGYIESGVKQVNLCGWNERWRSVPSFVKFMFLTQPNWCYA

SEQ ID NO: 4810 - protein, 30 aa, synthetic construct
  REGION 1..30: note = Synthetic
GKVAEAIVDAAKAAKTIIADTDDAPEHEEL

SEQ ID NO: 4811 - protein, 25 aa, synthetic construct
  REGION 1..25: note = Synthetic
GLLSVLGSVAQHVLPHVVPVIAEHL

SEQ ID NO: 4812 - protein, 37 aa, synthetic construct
  REGION 1..37: note = Synthetic
FKGARDCGEQGQGCYTRPCCPGLHCAAGATGGGSCQP

SEQ ID NO: 4813 - protein, 42 aa, synthetic construct
  REGION 1..42: note = Synthetic
AQYAAELRRYINMLTRPRYGKRDKEGTLDFLECGSPHSAVPR

SEQ ID NO: 4814 - protein, 38 aa, synthetic construct
  REGION 1..38: note = Synthetic
DKARELISRIKQNELSAKMREWFSETFQKVKEKLKIDS

SEQ ID NO: 4815 - protein, 14 aa, synthetic construct
  REGION 1..14: note = Synthetic
VEIASEGVKRAIES

SEQ ID NO: 4816 - protein, 17 aa, synthetic construct
  REGION 1..17: note = Synthetic
GLMKEVKEIASAPPPAQ

SEQ ID NO: 4817 - protein, 17 aa, synthetic construct
  REGION 1..17: note = Synthetic
GAGVFGAAVAAGVAFLF

SEQ ID NO: 4818 - protein, 40 aa, synthetic construct
  REGION 1..40: note = Synthetic
AACDSLVDTVFNTVWTLGCRPFMNSQRAACICAEEEKEEL

SEQ ID NO: 4819 - protein, 32 aa, synthetic construct
  REGION 1..32: note = Synthetic
VTGLLGLLEELASNLPTGPFSPKPDLLGDDGF

SEQ ID NO: 4820 - protein, 42 aa, synthetic construct
  REGION 1..42: note = Synthetic
CYGAAGTCARVVCDCDRTAALCFGNSEYIEGHKNIDTARFCQ

SEQ ID NO: 4821 - protein, 32 aa, synthetic construct
  REGION 1..32: note = Synthetic
VAHVREMFSNVFNSIKTQREQAMAANGSQPTD

SEQ ID NO: 4822 - protein, 25 aa, synthetic construct
  REGION 1..25: note = Synthetic
LYTAFGNPASGLKDPFEGHEDWSDQ

SEQ ID NO: 4823 - protein, 14 aa, synthetic construct
  REGION 1..14: note = Synthetic
HAINAVSTLVHHSG

SEQ ID NO: 4824 - protein, 18 aa, synthetic construct
  REGION 1..18: note = Synthetic
KKIEEMIKYIASPAQASQ

SEQ ID NO: 4825 - protein, 27 aa, synthetic construct
  REGION 1..27: note = Synthetic
ATSIVNSLKTALTHRNNYKQFAITNAF

SEQ ID NO: 4826 - protein, 17 aa, synthetic construct
  REGION 1..17: note = Synthetic
GYNAAYNRYFRERRGAK

SEQ ID NO: 4827 - protein, 33 aa, synthetic construct
  REGION 1..33: note = Synthetic
CGTDGITYANECVLCFENRKRIEPVLIRKGGPC

SEQ ID NO: 4828 - protein, 17 aa, synthetic construct
  REGION 1..17: note = Synthetic
TSILDLLKKVVTKIVCE

SEQ ID NO: 4829 - protein, 37 aa, synthetic construct
  REGION 1..37: note = Synthetic
FKGARDCGGQGEGCYTQPCCPGLRCRGGGTGGGACQL

SEQ ID NO: 4830 - protein, 37 aa, synthetic construct
  REGION 1..37: note = Synthetic
FKGARDCGGQGEGCYTQPCCPGLRCRGGGTGGGVCQL

SEQ ID NO: 4831 - protein, 37 aa, synthetic construct; identical to SEQ ID NO: 4830
  REGION 1..37: note = Synthetic

SEQ ID NO: 4832 - protein, 37 aa, synthetic construct
  REGION 1..37: note = Synthetic
FKGARDCGGQGEGCYTQPCCPGLRCRGGGTGGGSCQP

SEQ ID NO: 4833 - protein, 30 aa, synthetic construct
  REGION 1..30: note = Synthetic
KCIDRCDEFCKTMEYPNGGDCNTGPCCCLW

SEQ ID NO: 4834 - protein, 25 aa, synthetic construct
  REGION 1..25: note = Synthetic
QKAEEWGRSGKNPNHFRPEGLPEKF

SEQ ID NO: 4835 - protein, 18 aa, synthetic construct
  REGION 1..18: note = Synthetic
GQSAGAKCMNGKCKCYPH

SEQ ID NO: 4836 - protein, 36 aa, synthetic construct
  REGION 1..36: note = Synthetic
KEGCRKLLGGCTIDDDCCPHLGCNKKYWHCGWDGTF

SEQ ID NO: 4837 - protein, 31 aa, synthetic construct
  REGION 1..31: note = Synthetic
KVAEKVASVASEAVDAAKTVIADTDEGHGEL

SEQ ID NO: 4838 - protein, 33 aa, synthetic construct
  REGION 1..33: note = Synthetic
CGSDGQTYGNKCAFCKALEKSSGKINLKHRGKC

SEQ ID NO: 4839 - protein, 33 aa, synthetic construct; identical to SEQ ID NO: 4838
  REGION 1..33: note = Synthetic

SEQ ID NO: 4840 - protein, 26 aa, synthetic construct
  REGION 1..26: note = Synthetic
KFFRSCVDHLSGAYDEKDDVEAPPPE

SEQ ID NO: 4841 - protein, 31 aa, synthetic construct
  REGION 1..31: note = Synthetic
VQSFVNDLIKCANYSLITVFSMLFALIYIMI

SEQ ID NO: 4842 - protein, 32 aa, synthetic construct
  REGION 1..32: note = Synthetic
AESVKTAASEAKKVAEAILVDAVDGDQEHMEL

SEQ ID NO: 4843 - protein, 29 aa, synthetic construct
  REGION 1..29: note = Synthetic
AEQVVQGMKEAQERLTGDAFRKKHLEDEL

SEQ ID NO: 4844 - protein, 20 aa, synthetic construct
  REGION 1..20: note = Synthetic
GRRCLAAAASSVAPGGRSGI

SEQ ID NO: 4845 - protein, 36 aa, synthetic construct
  REGION 1..36: note = Synthetic
ECDRVAATCFRDNKDTYDNKYWFFPAKNCQEESEPC

SEQ ID NO: 4846 - protein, 22 aa, synthetic construct
  REGION 1..22: note = Synthetic
LEEYLATIRGYLRHDLAAAETI

SEQ ID NO: 4847 - protein, 14 aa, synthetic construct
  REGION 1..14: note = Synthetic
TLFNQAADILDHVV

SEQ ID NO: 4848 - protein, 37 aa, synthetic construct
  REGION 1..37: note = Synthetic
IAAVVDVIRELGICPDDAAVIPIKNNRFYTIETLEVE

SEQ ID NO: 4849 - protein, 38 aa, synthetic construct; identical to SEQ ID NO: 4613
  REGION 1..38: note = Synthetic

SEQ ID NO: 4850 - protein, 30 aa, synthetic construct
  REGION 1..30: note = Synthetic
EECDEYCEDLNKNCCGLSNGEPVCATACLG

SEQ ID NO: 4851 - protein, 30 aa, synthetic construct
  REGION 1..30: note = Synthetic
GYGQHLGGPYGNSEPSWKVGSTYTYRFPNF

SEQ ID NO: 4852 - protein, 13 aa, synthetic construct
  REGION 1..13: note = Synthetic
EDLDHLAHSMEDS

SEQ ID NO: 4853 - protein, 20 aa, synthetic construct
  REGION 1..20: note = Synthetic
GHGYCNTLDDFSLCLCKYPC

SEQ ID NO: 4854 - protein, 18 aa, synthetic construct
  REGION 1..18: note = Synthetic
RQAESVVTTLAEALKLAG

SEQ ID NO: 4855 - protein, 38 aa, synthetic construct; identical to SEQ ID NO: 4613
  REGION 1..38: note = Synthetic

SEQ ID NO: 4856 - protein, 22 aa, synthetic construct
  REGION 1..22: note = Synthetic
DLLNTAGGLLGNLVGSLSGGER

SEQ ID NO: 4857 - protein, 37 aa, synthetic construct
  REGION 1..37: note = Synthetic
EDVVHTIIDFLSYLKLKEIGALDSLPSSLTSEEISQP

SEQ ID NO: 4858 - protein, 21 aa, synthetic construct
  REGION 1..21: note = Synthetic
VQYALSCFQQAVNGVGNENGN

SEQ ID NO: 4859 - protein, 30 aa, synthetic construct
  REGION 1..30: note = Synthetic
QGAKEALTELKSCIDGLQPTHKADLVELLV

SEQ ID NO: 4860 - protein, 21 aa, synthetic construct
  REGION 1..21: note = Synthetic
GIVEQCCASVCSLYQLEHYCN

SEQ ID NO: 4861 - protein, 21 aa, synthetic construct
  REGION 1..21: note = Synthetic
RSFRNGVGTGMKKTSFRRAKS

SEQ ID NO: 4862 - protein, 38 aa, synthetic construct
  REGION 1..38: note = Synthetic
VSYGHQGCSSLCVPMKFFRPNVTVDFRCCHDSPFCNKF

SEQ ID NO: 4863 - protein, 40 aa, synthetic construct
  REGION 1..40: note = Synthetic
MDEISSGVNACKDIKGTNDCDTAFKVTMCLKEHKAIPGHH

SEQ ID NO: 4864 - protein, 21 aa, synthetic construct
  REGION 1..21: note = Synthetic
RSFRNGVGSGAKKTSFRRAKQ

SEQ ID NO: 4865 - protein, 32 aa, synthetic construct
  REGION 1..32: note = Synthetic
IPEAIARALAYIEAHPPSPSVVERKVVANLLG

SEQ ID NO: 4866 - protein, 17 aa, synthetic construct
  REGION 1..17: note = Synthetic
GYNAAYNRYFRKRRGTK

SEQ ID NO: 4867 - protein, 34 aa, synthetic construct
  REGION 1..34: note = Synthetic
FASVGGKCQEFIYGGCGGNANNFQTQAECEAKCG

SEQ ID NO: 4868 - protein, 21 aa, synthetic construct
  REGION 1..21: note = Synthetic
RMKRMMEEFLYAVNKTEQALT

SEQ ID NO: 4869 - protein, 20 aa, synthetic construct
  REGION 1..20: note = Synthetic
QQAIHKAESFAEYLAKRQAS

SEQ ID NO: 4870 - protein, 42 aa, synthetic construct
  REGION 1..42: note = Synthetic
CKGGNNACAAAVCDCDRLAAICFAGAPYNNNNYNIDLKARCQ

SEQ ID NO: 4871 - protein, 23 aa, synthetic construct
  REGION 1..23: note = Synthetic
GHDLSEWLKGCDMHVKIDPKIHP

SEQ ID NO: 4872 - protein, 34 aa, synthetic construct
  REGION 1..34: note = Synthetic
CATFISCCGRAYEVDALNSVRTSPWLLAPGNNPH

SEQ ID NO: 4873 - protein, 18 aa, synthetic construct
  REGION 1..18: note = Synthetic
CSNFCSTLSDVCQESWSG

SEQ ID NO: 4874 - protein, 18 aa, synthetic construct
  REGION 1..18: note = Synthetic
AEAQGMIGTLTSKRIKQG

SEQ ID NO: 4875 - protein, 29 aa, synthetic construct
  REGION 1..29: note = Synthetic
AEQVVQGMKEAQERLTGDAFREKHFQDEL

SEQ ID NO: 4876 - protein, 25 aa, synthetic construct
  REGION 1..25: note = Synthetic
WVGSCETGWHKCNTEHNLFHECCKQ

SEQ ID NO: 4877 - protein, 19 aa, synthetic construct
  REGION 1..19: note = Synthetic
TAFGPVSKGLRDPFEEHEE

SEQ ID NO: 4878 - protein, 25 aa, synthetic construct
  REGION 1..25: note = Synthetic
WVGSCASGWHKCNTEHNIFHECCKE

SEQ ID NO: 4879 - protein, 29 aa, synthetic construct
  REGION 1..29: note = Synthetic
ATEFCREILYLASSLREILLYDSWLISNT

SEQ ID NO: 4880 - protein, 31 aa, synthetic construct
  REGION 1..31: note = Synthetic
HLLRTLLELARTQSQRERAEQNRIIFDSVGK

SEQ ID NO: 4881 - protein, 29 aa, synthetic construct
  REGION 1..29: note = Synthetic
AQEILQRLETIAQDPSTCEICAYAACAGC

SEQ ID NO: 4882 - protein, 39 aa, synthetic construct
  REGION 1..39: note = Synthetic
QPADQAAERMQAEQHPLFDQKRRCCKFPCPDSCRYLCCG

SEQ ID NO: 4883 - protein, 27 aa, synthetic construct
  REGION 1..27: note = Synthetic
STFTRAFQAWVGLVIVIAAADGISSAI

SEQ ID NO: 4884 - protein, 30 aa, synthetic construct
  REGION 1..30: note = Synthetic
ETACRHAKSLGNCRTSQKYRANCAKTCELC

SEQ ID NO: 4885 - protein, 29 aa, synthetic construct
  REGION 1..29: note = Synthetic
SAVYYCARDAQYVVNCHDWTTALMTGLTT

SEQ ID NO: 4886 - protein, 28 aa, synthetic construct
  REGION 1..28: note = Synthetic
ASSIFKTLRTIANDDCELCVNVACTGCL

SEQ ID NO: 4887 - protein, 15 aa, synthetic construct
  REGION 1..15: note = Synthetic
GDTGCAQVLEFSKPI

SEQ ID NO: 4888 - protein, 38 aa, synthetic construct
  REGION 1..38: note = Synthetic
DKVREFFNRVKESDIPAKTRNWFSETLQKVKEKLRIES

SEQ ID NO: 4889 - protein, 38 aa, synthetic construct; identical to SEQ ID NO: 4888
  REGION 1..38: note = Synthetic

SEQ ID NO: 4890 - protein, 38 aa, synthetic construct; identical to SEQ ID NO: 4888
  REGION 1..38: note = Synthetic

SEQ ID NO: 4891 - protein, 27 aa, synthetic construct
  REGION 1..27: note = Synthetic
QCCSTFCNPVTNMCIDWLGIGLSRSVL

SEQ ID NO: 4892 - protein, 27 aa, synthetic construct
  REGION 1..27: note = Synthetic
QCCSTFCNPVTNMCIDWLGIGLSRSVL

SEQ ID NO: 4893 - protein, 22 aa, synthetic construct
  REGION 1..22: note = Synthetic
ATECCEKMCTMEDITTKCCPSR

SEQ ID NO: 4894 - protein, 37 aa, synthetic construct
  REGION 1..37: note = Synthetic
RECTKFLGGCSEDSECCPHLGCKDVLYYCAWDGTFGK

SEQ ID NO: 4895 - protein, 37 aa, synthetic construct; identical to SEQ ID NO: 4894
  REGION 1..37: note = Synthetic

SEQ ID NO: 4896 - protein, 37 aa, synthetic construct; identical to SEQ ID NO: 4894
  REGION 1..37: note = Synthetic

SEQ ID NO: 4897 - protein, 39 aa, synthetic construct
  REGION 1..39: note = Synthetic
DSFVQVYQECCKKEMGLREYCEEIYTELPIRSGLWQPNK

SEQ ID NO: 4898 - protein, 33 aa, synthetic construct
  REGION 1..33: note = Synthetic
EAARCLKKAAYNLEYAVYPDFLCGAEYPTCAYN

SEQ ID NO: 4899 - protein, 14 aa, synthetic construct
  REGION 1..14: note = Synthetic
RGYEIGHGYGQRAY

SEQ ID NO: 4900 - protein, 19 aa, synthetic construct
  REGION 1..19: note = Synthetic
LGKCYTAGCSCSWPVCYRN

SEQ ID NO: 4901 - protein, 25 aa, synthetic construct
  REGION 1..25: note = Synthetic
FYGGCGGNANNFETRDECRQTCGGK

SEQ ID NO: 4902 - protein, 14 aa, synthetic construct
  REGION 1..14: note = Synthetic
LFDAIGNLLGGLGL

SEQ ID NO: 4903 - protein, 20 aa, synthetic construct
  REGION 1..20: note = Synthetic
AAYTCCSNACNLNTKKCVLS

SEQ ID NO: 4904 - protein, 12 aa, synthetic construct
  REGION 1..12: note = Synthetic
GLLDALSGILGL

SEQ ID NO: 4905 - protein, 35 aa, synthetic construct
  REGION 1..35: note = Synthetic
VARCGQKVPDLPSVPEEKQLPPTGKESPGTEPPSH

SEQ ID NO: 4906 - protein, 38 aa, synthetic construct
  REGION 1..38: note = Synthetic
GSEIIENAVDFILRSMSRGSSFMELEGDPGQQPSKVTS

SEQ ID NO: 4907 - protein, 41 aa, synthetic construct
  REGION 1..41: note = Synthetic
MKNFTTYLSTAPVVATGWFIVTAALLIEINRFFPDPLVFSF

SEQ ID NO: 4908 - protein, 26 aa, synthetic construct
  REGION 1..26: note = Synthetic
SVGNWISNLLSPVDTSGVAPPAVNEN

SEQ ID NO: 4909 - protein, 11 aa, synthetic construct
  REGION 1..11: note = Synthetic
QWCDGACDCCS

SEQ ID NO: 4910 - protein, 20 aa, synthetic construct
  REGION 1..20: note = Synthetic
GGGMMRGAGAAGGGAAGPGM

SEQ ID NO: 4911 - protein, 29 aa, synthetic construct
  REGION 1..29: note = Synthetic
KYAMKAWDNMMNIITPRPIAACTAQKVNT

SEQ ID NO: 4912 - protein, 40 aa, synthetic construct
  REGION 1..40: note = Synthetic
YPTGCTTCCTGYKGCYYFGTNGKFVCEGESDEPKPYMSTA

SEQ ID NO: 4913 - protein, 30 aa, synthetic construct
  REGION 1..30: note = Synthetic
NELLEEISAAVAGSGPTGAGSGEPSVFGKH

SEQ ID NO: 4914 - protein, 20 aa, synthetic construct
  REGION 1..20: note = Synthetic
VASVAAEMMQHVYCAASRRC

SEQ ID NO: 4915 - protein, 19 aa, synthetic construct
  REGION 1..19: note = Synthetic
ECNQWCTGGCSSVKGNCES

SEQ ID NO: 4916 - protein, 25 aa, synthetic construct
  REGION 1..25: note = Synthetic
RKVLYGLSYCCQHFIHLNINKRESE

SEQ ID NO: 4917 - protein, 31 aa, synthetic construct
  REGION 1..31: note = Synthetic
VDAAGDRFARSVQFLKNLTPGSELFAVEKNE

SEQ ID NO: 4918 - protein, 32 aa, synthetic construct
  REGION 1..32: note = Synthetic
DELINIIDGVLRDDDKNNDGYIDYAEFAKSLQ

SEQ ID NO: 4919 - protein, 32 aa, synthetic construct; identical to SEQ ID NO: 4918
  REGION 1..32: note = Synthetic

SEQ ID NO: 4920 - protein, 18 aa, synthetic construct
  REGION 1..18: note = Synthetic
VQGCKEALDELGLFPLEF

SEQ ID NO: 4921 - protein, 30 aa, synthetic construct
  REGION 1..30: note = Synthetic
CATYGQKCRTWSPPNCCWNLRCKAFRCRPR

SEQ ID NO: 4922 - protein, 11 aa, synthetic construct
  REGION 1..11: note = Synthetic
YTAVADCCHQA

SEQ ID NO: 4923 - protein, 33 aa, synthetic construct
  REGION 1..33: note = Synthetic
VEDVVDDAGDVVEDAVDGTPAENVVDDGPFDLD

SEQ ID NO: 4924 - protein, 30 aa, synthetic construct
  REGION 1..30: note = Synthetic
HVREMFSNVFNSIKTQREQAMAANGSQPTD

SEQ ID NO: 4925 - protein, 25 aa, synthetic construct
  REGION 1..25: note = Synthetic
TGYALYTAFGKPSKELRDPFEEHED

SEQ ID NO: 4926 - protein, 31 aa, synthetic construct
  REGION 1..31: note = Synthetic
MKYMGSFLRKAATTNLFNSIKKRKVQNRAMS

SEQ ID NO: 4927 - protein, 22 aa, synthetic construct
  REGION 1..22: note = Synthetic
FDSGRECCGSFACRFGCVPCCV

SEQ ID NO: 4928 - protein, 33 aa, synthetic construct
  REGION 1..33: note = Synthetic
NVAEKIASKVAEAADVVKTIVADTDDGQEHNEL

SEQ ID NO: 4929 - protein, 31 aa, synthetic construct
  REGION 1..31: note = Synthetic
WSGFVKRLTNYLATTGHGTNTGGPVLTRRFG

SEQ ID NO: 4930 - protein, 28 aa, synthetic construct
  REGION 1..28: note = Synthetic
AFAIFSRLAQNFAPRAIFSLLPYHSVSC

SEQ ID NO: 4931 - protein, 34 aa, synthetic construct
  REGION 1..34: note = Synthetic
VDSMCRSVMRVCDEESISDKTLGDEEVRAKGKEL

SEQ ID NO: 4932 - protein, 19 aa, synthetic construct
  REGION 1..19: note = Synthetic
ECSQWCTAGCNSITSKCDT

SEQ ID NO: 4933 - protein, 21 aa, synthetic construct
  REGION 1..21: note = Synthetic
ACYVASTCCSNACNLNSNKCV

SEQ ID NO: 4934 - protein, 23 aa, synthetic construct
  REGION 1..23: note = Synthetic
LNTAGGLLGDLLGSLGSLSGGES

SEQ ID NO: 4935 - protein, 25 aa, synthetic construct
  REGION 1..25: note = Synthetic
FYGGCGGNANNFETRDECRQTCGGK

SEQ ID NO: 4936 - protein, 25 aa, synthetic construct
  REGION 1..25: note = Synthetic
FYGGCGGNANNFETRDECRQTCGGK

SEQ ID NO: 4937 - protein, 34 aa, synthetic construct
  REGION 1..34: note = Synthetic
QKGKDGCDTAYETVKCYIAVNGKFIWEEIIVLLG

SEQ ID NO: 4938 - protein, 31 aa, synthetic construct
  REGION 1..31: note = Synthetic
FGRMESLLTSLRGSAESPAALGEASAAHPLE

SEQ ID NO: 4939 - protein, 30 aa, synthetic construct
  REGION 1..30: note = Synthetic
EKVASAVSEAAEAAKTFIADTDDVDGHEEL

SEQ ID NO: 4940 - protein, 23 aa, synthetic construct
  REGION 1..23: note = Synthetic
NELLEELSAAGGASAEPNVFGKH

SEQ ID NO: 4941 - protein, 23 aa, synthetic construct
  REGION 1..23: note = Synthetic
NELLEELSAAGGASAEPNVFGKH

SEQ ID NO: 4942 - protein, 23 aa, synthetic construct
  REGION 1..23: note = Synthetic
NELLEELSAAGGASAEPNVFGKH

SEQ ID NO: 4943 - protein, 34 aa, synthetic construct
  REGION 1..34: note = Synthetic
GGECERMADTCCPGLQCLGCNPFNKENLGKCKCQ

SEQ ID NO: 4944 - protein, 30 aa, synthetic construct; identical to SEQ ID NO: 4939
  REGION 1..30: note = Synthetic

SEQ ID NO: 4945 - protein, 18 aa, synthetic construct
  REGION 1..18: note = Synthetic
MKCCRNGCGKMACTTPKF

SEQ ID NO: 4946 - protein, 17 aa, synthetic construct
  REGION 1..17: note = Synthetic
ITECCQLMSGCAVEIKS

SEQ ID NO: 4947 - protein, 26 aa, synthetic construct
  REGION 1..26: note = Synthetic
LSHLLARIWKPYKKRETPDCFWKYCV

SEQ ID NO: 4948 - protein, 12 aa, synthetic construct
  REGION 1..12: note = Synthetic
YEEVASSLCGLK

SEQ ID NO: 4949 - protein, 12 aa, synthetic construct
  REGION 1..12: note = Synthetic
YEEVASSLCGLK

SEQ ID NO: 4950 - protein, 12 aa, synthetic construct
  REGION 1..12: note = Synthetic
YEEVASSLCGLK

SEQ ID NO: 4951 - protein, 14 aa, synthetic construct
  REGION 1..14: note = Synthetic
AVYTPVASCCRKKK

SEQ ID NO: 4952 - protein, 32 aa, synthetic construct
  REGION 1..32: note = Synthetic
DEIANVVDSVLKDMDLDGDGFIDYTEYATKML

SEQ ID NO: 4953 - protein, 32 aa, synthetic construct; identical to SEQ ID NO: 4952
  REGION 1..32: note = Synthetic

SEQ ID NO: 4954 - protein, 29 aa, synthetic construct
  REGION 1..29: note = Synthetic
AEQVVQGMKEAQERLTGDAFREKHLEDEL

SEQ ID NO: 4955 - protein, 25 aa, synthetic construct
  REGION 1..25: note = Synthetic
SHYYASLCHYLNVVTRQWWEGADMW

SEQ ID NO: 4956 - protein, 35 aa, synthetic construct
  REGION 1..35: note = Synthetic
AFHNAPKLAQTMTCTFEVYNIPWRNFISLEKSSCT

SEQ ID NO: 4957 - protein, 34 aa, synthetic construct
  REGION 1..34: note = Synthetic
SGYCQWAGRYGNACWCIDLPDKVPIRISGSCRGR

SEQ ID NO: 4958 - protein, 16 aa, synthetic construct
  REGION 1..16: note = Synthetic
AGAAGVALAGALAFLI

SEQ ID NO: 4959 - protein, 30 aa, synthetic construct
  REGION 1..30: note = Synthetic
MRELISNAADALEKIRFLSLSDESVLNDEK

SEQ ID NO: 4960 - protein, 24 aa, synthetic construct
  REGION 1..24: note = Synthetic
IYGGCYGNANNFKTIDECKRTCAA

SEQ ID NO: 4961 - protein, 24 aa, synthetic construct
  REGION 1..24: note = Synthetic
IYGGCYGNANNFKTIDECKRTCAA

SEQ ID NO: 4962 - protein, 30 aa, synthetic construct; identical to SEQ ID NO: 4939
  REGION 1..30: note = Synthetic

SEQ ID NO: 4963 - protein, 17 aa, synthetic construct
  REGION 1..17: note = Synthetic
QWCTAGCNSITSKCDTL

SEQ ID NO: 4964 - protein, 13 aa, synthetic construct
  REGION 1..13: note = Synthetic
KGRAIAGTCCKRE

SEQ ID NO: 4965 - protein, 34 aa, synthetic construct
  REGION 1..34: note = Synthetic
VSYFASKIARVLEDRYSEFAKQMADVVDKEGKYY

SEQ ID NO: 4966 - protein, 23 aa, synthetic construct
  REGION 1..23: note = Synthetic
ERILSLVEEILSEVRFARGRFLW

SEQ ID NO: 4967 - protein, 37 aa, synthetic construct
  REGION 1..37: note = Synthetic
EELDKWMNSMNRNADYECLPTLKEEKEPNPSPSDNES

SEQ ID NO: 4968 - protein, 32 aa, synthetic construct
  REGION 1..32: note = Synthetic
SAVNRIGTILESWVRWDLAVLGDAYDSDDVNE

SEQ ID NO: 4969 - protein, 19 aa, synthetic construct
  REGION 1..19: note = Synthetic
HASNAIDRAVRLLYDRSLC

SEQ ID NO: 4970 - protein, 25 aa, synthetic construct
  REGION 1..25: note = Synthetic
IPEAIARAVAWLESHPPAPEHPRHH

SEQ ID NO: 4971 - protein, 25 aa, synthetic construct
  REGION 1..25: note = Synthetic
IPEAIARAVAWLESHPPAPEHPRHH

SEQ ID NO: 4972 - protein, 37 aa, synthetic construct
  REGION 1..37: note = Synthetic
IAAVVDVIRELGICPDDAAVIPIKNNRFYTTETLEVE

SEQ ID NO: 4973 - protein, 27 aa, synthetic construct
  REGION 1..27: note = Synthetic
ADNANRILRTLWNLRGCCEDKTCCFIG

SEQ ID NO: 4974 - protein, 27 aa, synthetic construct
  REGION 1..27: note = Synthetic
ADNANRILRTLWNLRGCCEDKTCCFIG

SEQ ID NO: 4975 - protein, 27 aa, synthetic construct
  REGION 1..27: note = Synthetic
ADNANRILRTLWNLRGCCEDKTCCFIG

SEQ ID NO: 4976 - protein, 12 aa, synthetic construct
  REGION 1..12: note = Synthetic
ENAVEFARELAN

SEQ ID NO: 4977 - protein, 33 aa, synthetic construct
  REGION 1..33: note = Synthetic
SGYCQWGGRYGNACWCIKLPDRVPIRVPGKCHR

SEQ ID NO: 4978 - protein, 37 aa, synthetic construct
  REGION 1..37: note = Synthetic
IAAVVDVIQELGICPDDAAVIPIKNNRFYTTEILKVE

SEQ ID NO: 4979 - protein, 37 aa, synthetic construct
  REGION 1..37: note = Synthetic
AALASFYDNAKRTLQRHWAKSLCCPEDAWCCSHDEGK

SEQ ID NO: 4980 - protein, 29 aa, synthetic construct
  REGION 1..29: note = Synthetic
CTSWLATCTDASQCCTGVCYKRAYCALWE

SEQ ID NO: 4981 - protein, 31 aa, synthetic construct
  REGION 1..31: note = Synthetic
RDAGNVLDHGFQRRRECPPWCPTSHCNAGTC

SEQ ID NO: 4982 - protein, 25 aa, synthetic construct
  REGION 1..25: note = Synthetic
IYGGCGGNGNKFPTQEACMKRCAKA

SEQ ID NO: 4983 - protein, 25 aa, synthetic construct
  REGION 1..25: note = Synthetic
IYGGCGGNGNKFPTQEACMKRCAKA

SEQ ID NO: 4984 - protein, 25 aa, synthetic construct
  REGION 1..25: note = Synthetic
IYGGCGGNGNKFPTQEACMKRCGKA

SEQ ID NO: 4985 - protein, 41 aa, synthetic construct
  REGION 1..41: note = Synthetic
ITQAVACAKKIVSQQGITAWVAWKNKCRNRDLTSYVKGCGV

SEQ ID NO: 4986 - protein, 36 aa, synthetic construct
  REGION 1..36: note = Synthetic
GGYGGYGRGYGGYGRGYGGYGRGMWGRPYGGYGWGK

SEQ ID NO: 4987 - protein, 32 aa, synthetic construct
  REGION 1..32: note = Synthetic
DELISIIDGVLRDDDKNNDGYIDYAEFAKSLQ

SEQ ID NO: 4988 - protein, 22 aa, synthetic construct
  REGION 1..22: note = Synthetic
QLVKEFVDLLTYAARTALMRNG

SEQ ID NO: 4989 - protein, 21 aa, synthetic construct
  REGION 1..21: note = Synthetic
TVLKQFSNCMAELQAKDNTTC

SEQ ID NO: 4990 - protein, 21 aa, synthetic construct
  REGION 1..21: note = Synthetic
SAAAAASSVAAGKKGYKRPSY

SEQ ID NO: 4991 - protein, 27 aa, synthetic construct
  REGION 1..27: note = Synthetic
NIIDSISDVAKQICCEITVQCCVLDEE

SEQ ID NO: 4992 - protein, 35 aa, synthetic construct
  REGION 1..35: note = Synthetic
DLVTKFLNNAFTAAQAAQTSEGTLESLQYYFIVRI

SEQ ID NO: 4993 - protein, 24 aa, synthetic construct
  REGION 1..24: note = Synthetic
LGTLAEELSSYSRRKGGFSFRFGR

SEQ ID NO: 4994 - protein, 24 aa, synthetic construct
  REGION 1..24: note = Synthetic
LGTLAEELSSYSRRKGGFSFRFGR

SEQ ID NO: 4995 - protein, 40 aa, synthetic construct
  REGION 1..40: note = Synthetic
AACDSLADTVFNTVWTLGCRPFMNSQRAACICAEEEKEEL

SEQ ID NO: 4996 - protein, 37 aa, synthetic construct
  REGION 1..37: note = Synthetic
EELDKWMNSMNRNADFECLPTLKEEKESNHNPSDSES

SEQ ID NO: 4997 - protein, 22 aa, synthetic construct
  REGION 1..22: note = Synthetic
EAADELRKMVEEVANGDVGKAN

SEQ ID NO: 4998 - protein, 25 aa, synthetic construct
  REGION 1..25: note = Synthetic
TGYALYTAFGKPSKQLRDPFEEHED

SEQ ID NO: 4999 - protein, 42 aa, synthetic construct; identical to SEQ ID NO: 4670
  REGION 1..42: note = Synthetic

SEQ ID NO: 5000 - protein, 11 aa, synthetic construct
  REGION 1..11: note = Synthetic
QWCDGACDCCS

SEQ ID NO: 5001 - protein, 42 aa, synthetic construct
  REGION 1..42: note = Synthetic
ECFHDCITEGYDDGSCVPGPTTAKCGIITKTTNKICYSFAFE

SEQ ID NO: 5002 - protein, 24 aa, synthetic construct
  REGION 1..24: note = Synthetic
CGAHCLALGRRGGYCNSKSVCVCR

SEQ ID NO: 5003 - protein, 32 aa, synthetic construct
  REGION 1..32: note = Synthetic
KYLTSFGSNFGGILTIDLSFYWALGVALTGSK

SEQ ID NO: 5004 - protein, 23 aa, synthetic construct
  REGION 1..23: note = Synthetic
VVALVSAFVTGILALRLGRELYR

SEQ ID NO: 5005 - protein, 35 aa, synthetic construct
  REGION 1..35: note = Synthetic
THICTCLTDLCNNANVHAFKTEMIIFSLIIVKQFM

SEQ ID NO: 5006 - protein, 34 aa, synthetic construct
  REGION 1..34: note = Synthetic
WHVITDMFKNAFPFINWDFFPKVKGLRSAAPDSQ

SEQ ID NO: 5007 - protein, 29 aa, synthetic construct
  REGION 1..29: note = Synthetic
VKSAISEAAEAVKTALADTDGDGQEHNEL

SEQ ID NO: 5008 - protein, 34 aa, synthetic construct
  REGION 1..34: note = Synthetic
KDLCNGAAGAGHSPWALAGGLLLSLGPALLWAGP

SEQ ID NO: 5009 - protein, 42 aa, synthetic construct; identical to SEQ ID NO: 4870
  REGION 1..42: note = Synthetic

SEQ ID NO: 5010 - protein, 42 aa, synthetic construct; identical to SEQ ID NO: 4870
  REGION 1..42: note = Synthetic

SEQ ID NO: 5011 - protein, 20 aa, synthetic construct
  REGION 1..20: note = Synthetic
EYVDTYYSAVCGRYFCCRSR

SEQ ID NO: 5012 - protein, 21 aa, synthetic construct
  REGION 1..21: note = Synthetic
INGMENLVTNFQYFLPFDVPV

SEQ ID NO: 5013 - protein, 38 aa, synthetic construct
  REGION 1..38: note = Synthetic
RTCQGMGESCSSNYDCCGSLCCAGASLFNGCVMGFVAC

SEQ ID NO: 5014 - protein, 25 aa, synthetic construct
  REGION 1..25: note = Synthetic
NVFGKVIADAIEYNYTQVGMTQTHS

SEQ ID NO: 5015 - protein, 31 aa, synthetic construct
  REGION 1..31: note = Synthetic
RDAGNVLDHGFQRRRDCPPWCPTSHCNAGTC

SEQ ID NO: 5016 - protein, 17 aa, synthetic construct
  REGION 1..17: note = Synthetic
VHHMADELLRNGPDTVI

SEQ ID NO: 5017 - protein, 24 aa, synthetic construct
  REGION 1..24: note = Synthetic
HVAKTLCSEVSDHCKSSVFQHSEL

SEQ ID NO: 5018 - protein, 32 aa, synthetic construct
  REGION 1..32: note = Synthetic
KQAGKLMNEAVEHLEYHATSKDGYEPYERGIN

SEQ ID NO: 5019 - protein, 11 aa, synthetic construct
  REGION 1..11: note = Synthetic
QWCDGACDCCA

SEQ ID NO: 5020 - protein, 35 aa, synthetic construct
  REGION 1..35: note = Synthetic
GTWCHTYANRCQVRITEEELMKQREKILGRKGKDY

SEQ ID NO: 5021 - protein, 40 aa, synthetic construct
  REGION 1..40: note = Synthetic
AECVGDGQRCADWAGPYCCSGYYCSCRSMPYCRCRSDSGK

SEQ ID NO: 5022 - protein, 38 aa, synthetic construct
  REGION 1..38: note = Synthetic
ADCVGDGQRCADWAGPYCCSGYYCSCRSMPYCRCRSDS

SEQ ID NO: 5023 - protein, 38 aa, synthetic construct; identical to SEQ ID NO: 5022
  REGION 1..38: note = Synthetic

SEQ ID NO: 5024 - protein, 19 aa, synthetic construct
  REGION 1..19: note = Synthetic
ILAAAATALTCLLPGLWSG

SEQ ID NO: 5025 - protein, 16 aa, synthetic construct
  REGION 1..16: note = Synthetic
GYPAAYRHYFGRRRNK

SEQ ID NO: 5026 - protein, 27 aa, synthetic construct
  REGION 1..27: note = Synthetic
CAAECLKAYKNGKGTCWQKFCQCVYDC

SEQ ID NO: 5027 - protein, 14 aa, synthetic construct
  REGION 1..14: note = Synthetic
AWVQEYVADLKLKA

SEQ ID NO: 5028 - protein, 39 aa, synthetic construct
  REGION 1..39: note = Synthetic
DKARAAIEHIKQKEIMIKTRNWFSETLNKMKEKLKTTFA

SEQ ID NO: 5029 - protein, 41 aa, synthetic construct
  REGION 1..41: note = Synthetic
MENFQKYLSTAPVLLTIWLTFTAGFIIEINRFFPDLLGLYF

SEQ ID NO: 5030 - protein, 34 aa, synthetic construct
  REGION 1..34: note = Synthetic
YTNANAGLAAGLPGKCGVNIPYKISPSTDCKSIK

SEQ ID NO: 5031 - protein, 39 aa, synthetic construct
  REGION 1..39: note = Synthetic
EDAKAAMTELKSCIDGLQPMHKAELVKLLVQVLGSQDGA

SEQ ID NO: 5032 - protein, 18 aa, synthetic construct
  REGION 1..18: note = Synthetic
FVAVAARVFAHGAATLSQ

SEQ ID NO: 5033 - protein, 13 aa, synthetic construct
  REGION 1..13: note = Synthetic
DWVQDYMNKLELN

SEQ ID NO: 5034 - protein, 15 aa, synthetic construct
  REGION 1..15: note = Synthetic
NEAGKRCEDAIGLLV

SEQ ID NO: 5035 - protein, 17 aa, synthetic construct
  REGION 1..17: note = Synthetic
VIDAARRAAQRMNHCGP

SEQ ID NO: 5036 - protein, 27 aa, synthetic construct
  REGION 1..27: note = Synthetic
NIIDSISDVAKQICCQITVDCCVLDEE

SEQ ID NO: 5037 - protein, 27 aa, synthetic construct
  REGION 1..27: note = Synthetic
KCIEFCSSMGTADGQCNNENLCCCTHE

SEQ ID NO: 5038 - protein, 33 aa, synthetic construct
  REGION 1..33: note = Synthetic
SGYCQWVGKYGNGCWCKELPDNVPIRVPGKCHR

SEQ ID NO: 5039 - protein, 28 aa, synthetic construct
  REGION 1..28: note = Synthetic
DCLRAGFQKGGQCGSPCIPCPVKCCCQK

SEQ ID NO: 5040 - protein, 29 aa, synthetic construct
  REGION 1..29: note = Synthetic
AEEILERLETIAQDPSTCEICAYAACAGC

SEQ ID NO: 5041 - protein, 29 aa, synthetic construct
  REGION 1..29: note = Synthetic
AEEILERLETIAQDPSTCEICAYAACAGC

SEQ ID NO: 5042 - protein, 24 aa, synthetic construct
  REGION 1..24: note = Synthetic
VAETAHEAADKVYEVEEEAKEAVG

SEQ ID NO: 5043 - protein, 33 aa, synthetic construct
  REGION 1..33: note = Synthetic
ILTKVPDAAKSIAQGYIDDLNETLAEVVAYYTS

SEQ ID NO: 5044 - protein, 32 aa, synthetic construct
  REGION 1..32: note = Synthetic
DELVSIIDGVLRDDDKNNDGYIDYAEFAKSLQ

SEQ ID NO: 5045 - protein, 21 aa, synthetic construct
  REGION 1..21: note = Synthetic
FQAFVAVAARVFGHGAATLTP

SEQ ID NO: 5046 - protein, 25 aa, synthetic construct
  REGION 1..25: note = Synthetic
IYGGCGGNGNKFPTQEACMKRCAKA

SEQ ID NO: 5047 - protein, 33 aa, synthetic construct
  REGION 1..33: note = Synthetic
ETIRDIYSKGSAAISTYTGILTDQILTMLQGKQ

SEQ ID NO: 5048 - protein, 29 aa, synthetic construct
  REGION 1..29: note = Synthetic
VVTLLGAAASYFKLNNRRNCFRTHEPENV

SEQ ID NO: 5049 - protein, 23 aa, synthetic construct
  REGION 1..23: note = Synthetic
LNEVLSAFFDVEEPPEKGCIICF

SEQ ID NO: 5050 - protein, 24 aa, synthetic construct
  REGION 1..24: note = Synthetic
LTNFGQRMDAIIPGNCSNIVCSPK

SEQ ID NO: 5051 - protein, 41 aa, synthetic construct
  REGION 1..41: note = Synthetic
GRTLAKELEALREAKSHRPLIALPTQDPATHGGASSKASSD

SEQ ID NO: 5052 - protein, 41 aa, synthetic construct
  REGION 1..41: note = Synthetic
GRTLAKELEALREAKSHRPLIALPTQDPATHGGASSEASSD

SEQ ID NO: 5053 - protein, 42 aa, synthetic construct
  REGION 1..42: note = Synthetic
CKGGNDACAAAVCDCDRLAAICFAGAPYNDNNYNIDLKARCQ

SEQ ID NO: 5054 - protein, 30 aa, synthetic construct
  REGION 1..30: note = Synthetic
WRYIRGCADTCPVGKPYEMIECCSTDKCNR

SEQ ID NO: 5055 - protein, 24 aa, synthetic construct
  REGION 1..24: note = Synthetic
DEIFNSAKELVESAEVSKVHTSQV

SEQ ID NO: 5056 - protein, 17 aa, synthetic construct
  REGION 1..17: note = Synthetic
GYNAAYNRYFRQRPGAK

SEQ ID NO: 5057 - protein, 37 aa, synthetic construct
  REGION 1..37: note = Synthetic
DAAFRKFEALCSARSQQPSTSKPSLIDALCTSALKKE

SEQ ID NO: 5058 - protein, 26 aa, synthetic construct
  REGION 1..26: note = Synthetic
VKFMATVVQTGFVYWVGRVTKDIDVE

SEQ ID NO: 5059 - protein, 16 aa, synthetic construct
  REGION 1..16: note = Synthetic
MNKGGTLFEALVIKKQ

SEQ ID NO: 5060 - protein, 13 aa, synthetic construct
  REGION 1..13: note = Synthetic
GQDLSSYLAGCGL

SEQ ID NO: 5061 - protein, 32 aa, synthetic construct
  REGION 1..32: note = Synthetic
MASGVGGGSEGGPDDVKNSYIRVNGEPEIVYQ

SEQ ID NO: 5062 - protein, 15 aa, synthetic construct
  REGION 1..15: note = Synthetic
QCCDHFCSTATSTCI

SEQ ID NO: 5063 - protein, 23 aa, synthetic construct
  REGION 1..23: note = Synthetic
FTTCFKEAFAEVKPQIPKANLDE

SEQ ID NO: 5064 - protein, 29 aa, synthetic construct
  REGION 1..29: note = Synthetic
VKSAISEAAEAVKTALADSDGDGQEHNEL

SEQ ID NO: 5065 - protein, 29 aa, synthetic construct
  REGION 1..29: note = Synthetic
VKSAISEAAEAVKTALADSDGDGQEHNEL

SEQ ID NO: 5066 - protein, 39 aa, synthetic construct
  REGION 1..39: note = Synthetic
GDDVVSNYFTKGKRGKRLGILVVFSFIKEAILPSRQKIY

SEQ ID NO: 5067 - protein, 14 aa, synthetic construct
  REGION 1..14: note = Synthetic
LLDVVGNLLGGLGL

SEQ ID NO: 5068 - protein, 29 aa, synthetic construct
  REGION 1..29: note = Synthetic
RYDACVNACLEHHPNVRECEEACKNPVPP

SEQ ID NO: 5069 - protein, 42 aa, synthetic construct
  REGION 1..42: note = Synthetic
ESFQEFFGRGHEDTMADQEANRHGRSGKDPNYYRPPGLPAKY

SEQ ID NO: 5070 - protein, 39 aa, synthetic construct
  REGION 1..39: note = Synthetic
LSELNSACDDAWETCAWSRTCCSRNCCRGICVSRYYECP

SEQ ID NO: 5071 - protein, 13 aa, synthetic construct
  REGION 1..13: note = Synthetic
LLGGGGGGGGGLL

SEQ ID NO: 5072 - protein, 21 aa, synthetic construct
  REGION 1..21: note = Synthetic
LQAFVAVAARVFAHGAATLSP

SEQ ID NO: 5073 - protein, 20 aa, synthetic construct
  REGION 1..20: note = Synthetic
VIHIVDKVLEYVEEVVLGGR

SEQ ID NO: 5074 - protein, 41 aa, synthetic construct
  REGION 1..41: note = Synthetic
MNDFQKYLSTAPVLLTLWMTFTAGFIIEVNRFFPDMLGLYF

SEQ ID NO: 5075 - protein, 31 aa, synthetic construct
  REGION 1..31: note = Synthetic
EQLENGGTSLSEKTVLLLVTPFLAAAWSLHP

SEQ ID NO: 5076 - protein, 31 aa, synthetic construct
  REGION 1..31: note = Synthetic
GHCRSWYNDCCDGYYCSCMQPPNCICRNNNG

SEQ ID NO: 5077 - protein, 15 aa, synthetic construct
  REGION 1..15: note = Synthetic
ADTISNGLSAIFCAA

SEQ ID NO: 5078 - protein, 13 aa, synthetic construct
  REGION 1..13: note = Synthetic
VHDVSSYVEGCKL

SEQ ID NO: 5079 - protein, 13 aa, synthetic construct
  REGION 1..13: note = Synthetic
AFGNEYITYIENQ

SEQ ID NO: 5080 - protein, 13 aa, synthetic construct
  REGION 1..13: note = Synthetic
AFGNEYITYIENQ

SEQ ID NO: 5081 - protein, 40 aa, synthetic construct
  REGION 1..40: note = Synthetic
GGYGGYGRGMYGGYGRGMYGGYGRGMYGGYGRGMYGGWGK

SEQ ID NO: 5082 - protein, 34 aa, synthetic construct
  REGION 1..34: note = Synthetic
AATAIFRKLAGERNYTDEMVAMLPRQEECTVDEV

SEQ ID NO: 5083 - protein, 29 aa, synthetic construct
  REGION 1..29: note = Synthetic
RCGGWMAKCADSDDCCETFHCTRFNVCGK

SEQ ID NO: 5084 - protein, 29 aa, synthetic construct
  REGION 1..29: note = Synthetic
RCGGWMAKCADSDDCCETFHCTRFNVCGK

SEQ ID NO: 5085 - protein, 29 aa, synthetic construct
  REGION 1..29: note = Synthetic
RCGGWMAKCADSDDCCETFHCTRFNVCGK

SEQ ID NO: 5086 - protein, 13 aa, synthetic construct
  REGION 1..13: note = Synthetic
LKTAYRRIYGITI

SEQ ID NO: 5087 - protein, 32 aa, synthetic construct
  REGION 1..32: note = Synthetic
NAMESVVEKLESMLNFSVSDSPGGTFFEGTGH

SEQ ID NO: 5088 - protein, 31 aa, synthetic construct
  REGION 1..31: note = Synthetic
DEIPKIVEEILYTATFTVLMAIDDLRLRDAT

SEQ ID NO: 5089 - protein, 34 aa, synthetic construct
  REGION 1..34: note = Synthetic
WHVLTDMFKKALPFINWEFFPKVKGLRSAVPDSQ

SEQ ID NO: 5090 - protein, 26 aa, synthetic construct
  REGION 1..26: note = Synthetic
WSKIKEAAKTAGKMAMGFVNDMVGEQ

SEQ ID NO: 5091 - protein, 22 aa, synthetic construct
  REGION 1..22: note = Synthetic
QDAVSSMNTVVESVRLLGWIEK

SEQ ID NO: 5092 - protein, 34 aa, synthetic construct
  REGION 1..34: note = Synthetic
ANTVLERVEGAQQRWKLQVQEQRKTVFDRHKMLS

SEQ ID NO: 5093 - protein, 34 aa, synthetic construct; identical to SEQ ID NO: 5092
  REGION 1..34: note = Synthetic

SEQ ID NO: 5094 - protein, 33 aa, synthetic construct
  REGION 1..33: note = Synthetic
EALEEFKKLVQHKGLSEEDIFMPLQTGSCVLEH

SEQ ID NO: 5095 - protein, 13 aa, synthetic construct
  REGION 1..13: note = Synthetic
LKTAYKRIYGITI

SEQ ID NO: 5096 - protein, 13 aa, synthetic construct
  REGION 1..13: note = Synthetic
LKTAYKRIYGITI

SEQ ID NO: 5097 - protein, 38 aa, synthetic construct
  REGION 1..38: note = Synthetic
GGYHGGGGSCYHYCHGRCCSAAEAKALEATTAQVKPQN

SEQ ID NO: 5098 - protein, 13 aa, synthetic construct
  REGION 1..13: note = Synthetic
DWVQEYMDDLELN

SEQ ID NO: 5099 - protein, 25 aa, synthetic construct
  REGION 1..25: note = Synthetic
INELHELANQCDPDAHHDHPHCHPH

SEQ ID NO: 5100 - protein, 21 aa, synthetic construct
  REGION 1..21: note = Synthetic
IDIIEKLLNEADLSILIIVIC

SEQ ID NO: 5101 - protein, 23 aa, synthetic construct
  REGION 1..23: note = Synthetic
YSGCGGNANRFKTIEECRRTCVG

SEQ ID NO: 5102 - protein, 42 aa, synthetic construct
  REGION 1..42: note = Synthetic
EAFQEFFGRGHEDTIADQEANRHGRSGKDPNYYRPPGLPDKY

SEQ ID NO: 5103 - protein, 41 aa, synthetic construct
  REGION 1..41: note = Synthetic
MNDLQKYLSTAPVLLTLWMTFTAGFIIEINRFFPDMLGLYF

SEQ ID NO: 5104 - protein, 28 aa, synthetic construct
  REGION 1..28: note = Synthetic
AVKKYLAAVLGKRYRQRYRNKGRRLGYL

SEQ ID NO: 5105 - protein, 17 aa, synthetic construct
  REGION 1..17: note = Synthetic
VIDAARRAAQRMNHCGP

SEQ ID NO: 5106 - protein, 27 aa, synthetic construct
  REGION 1..27: note = Synthetic
SDFTKGFQAWVALVLVIAAADGVASSL

SEQ ID NO: 5107 - protein, 25 aa, synthetic construct
  REGION 1..25: note = Synthetic
SACDIASEFIKCLSRQKECPVFEFP

SEQ ID NO: 5108 - protein, 30 aa, synthetic construct
  REGION 1..30: note = Synthetic
ARCGGWMAKCADSDDCCEAFHCTRFNVCGK

SEQ ID NO: 5109 - protein, 33 aa, synthetic construct
  REGION 1..33: note = Synthetic
KIAETVASAVSEAAEAAETVVADTDDVQGHNEL

SEQ ID NO: 5110 - protein, 14 aa, synthetic construct
  REGION 1..14: note = Synthetic
VSSALDAAATATGN

SEQ ID NO: 5111 - protein, 11 aa, synthetic construct
  REGION 1..11: note = Synthetic
GWCDGGCDCCQ

SEQ ID NO: 5112 - protein, 37 aa, synthetic construct
  REGION 1..37: note = Synthetic
IAAVIDVIQELGICPDDAAVIPIKNNRFYTTEILEVE

SEQ ID NO: 5113 - protein, 31 aa, synthetic construct; identical to SEQ ID NO: 4880
  REGION 1..31: note = Synthetic

SEQ ID NO: 5114 - protein, 31 aa, synthetic construct; identical to SEQ ID NO: 4880
  REGION 1..31: note = Synthetic

SEQ ID NO: 5115 - protein, 42 aa, synthetic construct
  REGION 1..42: note = Synthetic
CTTCCTGYTDCYYFGKDGKFVCEGESIEPKACTLECDSRLHT

SEQ ID NO: 5116 - protein, 37 aa, synthetic construct
  REGION 1..37: note = Synthetic
AEQVTRVITGVPWYSTRLRPAISSALSKDGIYTAIPK

SEQ ID NO: 5117 - protein, 29 aa, synthetic construct
  REGION 1..29: note = Synthetic
RCRSAYEDCCDGYYCNCSQPPYCLCRNNN

SEQ ID NO: 5118 - protein, 30 aa, synthetic construct
  REGION 1..30: note = Synthetic
LSGIMSNLGTVGNMVGGFCCTVYSGCCSEK

SEQ ID NO: 5119 - protein, 22 aa, synthetic construct
  REGION 1..22: note = Synthetic
AEKALDVVEKVASIAAAGATLG

SEQ ID NO: 5120 - protein, 12 aa, synthetic construct
  REGION 1..12: note = Synthetic
NVLGRCGSGLHV

SEQ ID NO: 5121 - protein, 40 aa, synthetic construct
  REGION 1..40: note = Synthetic
TDCVGDGQRCADWAGPYCCSGYYCSCRSMPYCRCRSDSGK

SEQ ID NO: 5122 - protein, 32 aa, synthetic construct
  REGION 1..32: note = Synthetic
LLDTLKNMATNAAKGAGVSVLKALSCKLFKTC

SEQ ID NO: 5123 - protein, 22 aa, synthetic construct
  REGION 1..22: note = Synthetic
GGVSELVAPVGAVVGALAVALM

SEQ ID NO: 5124 - protein, 29 aa, synthetic construct
  REGION 1..29: note = Synthetic
KRGCREGGEFCGTLYEERCCSGWCFFVCV

SEQ ID NO: 5125 - protein, 29 aa, synthetic construct
  REGION 1..29: note = Synthetic
KRGCREGGEFCGTLYEERCCSGWCFFVCV

SEQ ID NO: 5126 - protein, 25 aa, synthetic construct
  REGION 1..25: note = Synthetic
ASVIRGVIETAVFAGKILHKRDDGQ

SEQ ID NO: 5127 - protein, 23 aa, synthetic construct
  REGION 1..23: note = Synthetic
DAFRECLKLFTPRRHTRHLRQKY

SEQ ID NO: 5128 - protein, 21 aa, synthetic construct
  REGION 1..21: note = Synthetic
LQAFVAVAARVFAHGAATLTP

SEQ ID NO: 5129 - protein, 38 aa, synthetic construct
  REGION 1..38: note = Synthetic
LSYGHQGCSQLCIPMKLFNPSVIVEYKCCHDSPLCNKF

SEQ ID NO: 5130 - protein, 42 aa, synthetic construct
  REGION 1..42: note = Synthetic
DAVSAVASVVQDEMKVIDDVQQLEKDKQQLKDDIGFLTGERE

SEQ ID NO: 5131 - protein, 22 aa, synthetic construct
  REGION 1..22: note = Synthetic
GAIGKFMNVLRRSGCPWDPWCG

SEQ ID NO: 5132 - protein, 29 aa, synthetic construct
  REGION 1..29: note = Synthetic
AEEILQRLEAIAQDPNTCEICAYAACTGC

SEQ ID NO: 5133 - protein, 29 aa, synthetic construct
  REGION 1..29: note = Synthetic
AEEILQRLEAIAQDPNTCEICAYAACTGC

SEQ ID NO: 5134 - protein, 29 aa, synthetic construct
  REGION 1..29: note = Synthetic
AEEILQRLEAIAQDPNTCEICAYAACTGC

SEQ ID NO: 5135 - protein, 32 aa, synthetic construct
  REGION 1..32: note = Synthetic
AQVAQQLTAMCGLQLQQPGPCPCNAAAGGVYY

SEQ ID NO: 5136 - protein, 27 aa, synthetic construct
  REGION 1..27: note = Synthetic
KANQACTKGGNPGTCGFQYDLCLCLRN

SEQ ID NO: 5137 - protein, 34 aa, synthetic construct
  REGION 1..34: note = Synthetic
AQKAARLAAAAAALAAKTAADAAAKAAAIAAAAA

SEQ ID NO: 5138 - protein, 30 aa, synthetic construct
  REGION 1..30: note = Synthetic
DDCGKLFSGCDTNADCCEGYVCRLWCKLDW

SEQ ID NO: 5139 - protein, 42 aa, synthetic construct
  REGION 1..42: note = Synthetic
GAQFASYGSAWLMPYSEGRGKRGIVDECCLRPCSVDVLLSYC

SEQ ID NO: 5140 - protein, 12 aa, synthetic construct
  REGION 1..12: note = Synthetic
GLQCCQKYVAVA

SEQ ID NO: 5141 - protein, 15 aa, synthetic construct
  REGION 1..15: note = Synthetic
QCCNEFCSTATRTCI

SEQ ID NO: 5142 - protein, 15 aa, synthetic construct
  REGION 1..15: note = Synthetic
QCCNEFCSTATRTCI

SEQ ID NO: 5143 - protein, 31 aa, synthetic construct
  REGION 1..31: note = Synthetic
GSIPACGESCFKGKCYTPGCSCSKYPLCAKN

SEQ ID NO: 5144 - protein, 34 aa, synthetic construct
  REGION 1..34: note = Synthetic
SGYCQWASKYGNACWCYKLPDDARIMKPGRCNGG

SEQ ID NO: 5145 - protein, 33 aa, synthetic construct
  REGION 1..33: note = Synthetic
DLCNGVAQAGLSPWALAGGLLLSLGPALLWAGP

SEQ ID NO: 5146 - protein, 33 aa, synthetic construct
  REGION 1..33: note = Synthetic
NLAEKVANAASEAAEAAKTFVADSDDMDGHEEL

SEQ ID NO: 5147 - protein, 35 aa, synthetic construct
  REGION 1..35: note = Synthetic
RGYGGYGGYGRGMYGGYGRGMYGGYGRGMYGGWGK

SEQ ID NO: 5148 - protein, 16 aa, synthetic construct
  REGION 1..16: note = Synthetic
WMDFGKRAIEDVDYEY

SEQ ID NO: 5149 - protein, 13 aa, synthetic construct
  REGION 1..13: note = Synthetic
LKSLTSGAQQATT

SEQ ID NO: 5150 - protein, 33 aa, synthetic construct
  REGION 1..33: note = Synthetic
CGSDYITYGNKCKLCTEILRSNGKIQFLHEGHC

SEQ ID NO: 5151 - protein, 13 aa, synthetic construct
  REGION 1..13: note = Synthetic
SWVQEYVDDLELN

SEQ ID NO: 5152 - protein, 28 aa, synthetic construct
  REGION 1..28: note = Synthetic
GDCTGWLDGCTSPAECCTAVCDATCKLW

SEQ ID NO: 5153 - protein, 13 aa, synthetic construct
  REGION 1..13: note = Synthetic
QYSHLGGNWARNK

SEQ ID NO: 5154 - protein, 17 aa, synthetic construct
  REGION 1..17: note = Synthetic
KCCRNGCGKVSCVTPNF

SEQ ID NO: 5155 - protein, 35 aa, synthetic construct
  REGION 1..35: note = Synthetic
GVVAAVVAAVAGAVSSFVAYQRRRLCFREGGSAPV

SEQ ID NO: 5156 - protein, 24 aa, synthetic construct
  REGION 1..24: note = Synthetic
DEMVQRVQDVLQSAALDAIHKREG

SEQ ID NO: 5157 - protein, 30 aa, synthetic construct
  REGION 1..30: note = Synthetic
DDCGGLFSGCDSNADCCEGYVCRLWCKYKL

SEQ ID NO: 5158 - protein, 15 aa, synthetic construct
  REGION 1..15: note = Synthetic
LISAATAVFALLVLT

SEQ ID NO: 5159 - protein, 28 aa, synthetic construct
  REGION 1..28: note = Synthetic
DEMNTVLDNLATRDFINWLLHTKITDSL

SEQ ID NO: 5160 - protein, 35 aa, synthetic construct
  REGION 1..35: note = Synthetic
FKTMFHHAFEYASDASPDYRQLLQDALDKGLSAFK

SEQ ID NO: 5161 - protein, 39 aa, synthetic construct
  REGION 1..39: note = Synthetic
AGELLQQLREISATKIRFARQHQEAEREPRPMYPRRRKT

SEQ ID NO: 5162 - protein, 33 aa, synthetic construct
  REGION 1..33: note = Synthetic
DKAKEAATKAYEAAKKHVATAADKVKDWAASSK

SEQ ID NO: 5163 - protein, 28 aa, synthetic construct
  REGION 1..28: note = Synthetic
AVKKYLAAVLGKRYKQRVKNKGRRVAYL

SEQ ID NO: 5164 - protein, 14 aa, synthetic construct
  REGION 1..14: note = Synthetic
EWVQKYVSDLELSA

SEQ ID NO: 5165 - protein, 14 aa, synthetic construct
  REGION 1..14: note = Synthetic
EWVQKYVSDLELSA

SEQ ID NO: 5166 - protein, 14 aa, synthetic construct
  REGION 1..14: note = Synthetic
EWVQKYVSDLELSA

SEQ ID NO: 5167 - protein, 25 aa, synthetic construct
  REGION 1..25: note = Synthetic
KGFLSGLLNVADSVCCKVDTSCCSN

SEQ ID NO: 5168 - protein, 25 aa, synthetic construct
  REGION 1..25: note = Synthetic
IYGGCGGNANNFETRDQCRHTCGGK

SEQ ID NO: 5169 - protein, 37 aa, synthetic construct
  REGION 1..37: note = Synthetic
KVFTQIKGLVAENLVILEQMEKCEPESFYELPSRPSE

SEQ ID NO: 5170 - protein, 36 aa, synthetic construct
  REGION 1..36: note = Synthetic
VETLCTKIVSYGIDKLIEKILEGGSAKLICGLIHAC

SEQ ID NO: 5171 - protein, 24 aa, synthetic construct
  REGION 1..24: note = Synthetic
LTNFGQRMDAIIPGNCSNIVCSPK

SEQ ID NO: 5172 - protein, 24 aa, synthetic construct
  REGION 1..24: note = Synthetic
LTNFGQRMDAIIPGNCSNIVCSSK

SEQ ID NO: 5173 - protein, 21 aa, synthetic construct
  REGION 1..21: note = Synthetic
YCVHTMIDGVDYVVCDKITVY

SEQ ID NO: 5174 - protein, 15 aa, synthetic construct
  REGION 1..15: note = Synthetic
QCCDDFCSTATSTCV

SEQ ID NO: 5175 - protein, 37 aa, synthetic construct
  REGION 1..37: note = Synthetic
TQLKKLVDTLPQKTRMNIMKLSEIILTSPLCNQDLSV

SEQ ID NO: 5176 - protein, 29 aa, synthetic construct
  REGION 1..29: note = Synthetic
DDCGTLFSGCDTSKDCCEGYVCHLWCKYK

SEQ ID NO: 5177 - protein, 14 aa, synthetic construct
  REGION 1..14: note = Synthetic
VEIASEGVKRAIGS

SEQ ID NO: 5178 - protein, 33 aa, synthetic construct
  REGION 1..33: note = Synthetic
CGTDMNTYGNECTLCMKIREDGSHINIIKDEPC

SEQ ID NO: 5179 - protein, 28 aa, synthetic construct
  REGION 1..28: note = Synthetic
GINGLGAVGSWCLRSRRLPCRCPRLVNT

SEQ ID NO: 5180 - protein, 23 aa, synthetic construct
  REGION 1..23: note = Synthetic
LFYYFVEAATEAASKPLVLWLNG

SEQ ID NO: 5181 - protein, 29 aa, synthetic construct
  REGION 1..29: note = Synthetic
IAQEARSLADRLCSEKSGLCGTPANHTEL

SEQ ID NO: 5182 - protein, 34 aa, synthetic construct
  REGION 1..34: note = Synthetic
DAESIARTVMNEFDENRDGRLSAAEFDKALLGPR

SEQ ID NO: 5183 - protein, 11 aa, synthetic construct
  REGION 1..11: note = Synthetic
EWAQGGLEWAE

SEQ ID NO: 5184 - protein, 37 aa, synthetic construct
  REGION 1..37: note = Synthetic
GGGGGARRLKGLAKKRAGNGCFGLKLDRIGSMSGLGC

SEQ ID NO: 5185 - protein, 28 aa, synthetic construct
  REGION 1..28: note = Synthetic
TEAITVFEKLAEEAHGFAHFIDNSECFP

SEQ ID NO: 5186 - protein, 25 aa, synthetic construct
  REGION 1..25: note = Synthetic
IYGGCGGNGNKFPTEKACMKRCAKA

SEQ ID NO: 5187 - protein, 24 aa, synthetic construct
  REGION 1..24: note = Synthetic
TVVYFLYYIMSPLTSKIWDKILNQ

SEQ ID NO: 5188 - protein, 24 aa, synthetic construct
  REGION 1..24: note = Synthetic
TVVYFLYYIMSPLTSKIWDKILNQ

SEQ ID NO: 5189 - protein, 32 aa, synthetic construct
  REGION 1..32: note = Synthetic
ESLKTAARTAVEQATVITNQVQQSVQQAANAH

SEQ ID NO: 5190 - protein, 21 aa, synthetic construct
  REGION 1..21: note = Synthetic
QSMLTAIDDLLQALNFNSVTV

SEQ ID NO: 5191 - protein, 20 aa, synthetic construct
  REGION 1..20: note = Synthetic
AHNCLNKGDTYDKLHDGECK

SEQ ID NO: 5192 - protein, 39 aa, synthetic construct
  REGION 1..39: note = Synthetic
ATFGDRANGFCDYSTSTSPGGECTCVYHCPPVVPHESHL

SEQ ID NO: 5193 - protein, 23 aa, synthetic construct
  REGION 1..23: note = Synthetic
YSGCGGNANRFRTIDECNRTCVG

SEQ ID NO: 5194 - protein, 27 aa, synthetic construct
  REGION 1..27: note = Synthetic
ADDANRILQTLWNLRGCCEDKTCCFIG

SEQ ID NO: 5195 - protein, 40 aa, synthetic construct
  REGION 1..40: note = Synthetic
AGDGFNIAKQAMDQLTNGQAAGLGRIDANYQQVATSNCGL

SEQ ID NO: 5196 - protein, 23 aa, synthetic construct
  REGION 1..23: note = Synthetic
FYQSCVDQLNGVYEEKDTPPVKE

SEQ ID NO: 5197 - protein, 19 aa, synthetic construct
  REGION 1..19: note = Synthetic
STVIYRLQDVFNHWQICTV

SEQ ID NO: 5198 - protein, 18 aa, synthetic construct
  REGION 1..18: note = Synthetic
GYNAAYNRYFRQRRGAKY

SEQ ID NO: 5199 - protein, 28 aa, synthetic construct
  REGION 1..28: note = Synthetic
DEMNTILDNLAARDFINWLIQTKITDRK

SEQ ID NO: 5200 - protein, 20 aa, synthetic construct
  REGION 1..20: note = Synthetic
ECNQWCTGGCNPTQGKCDTA

SEQ ID NO: 5201 - protein, 26 aa, synthetic construct
  REGION 1..26: note = Synthetic
AEEVADDAAQGVEDVQKSADDVVDEA

SEQ ID NO: 5202 - protein, 30 aa, synthetic construct
  REGION 1..30: note = Synthetic
HNLASPISAWIDPSHYCCCGGGCTDDCVNC

SEQ ID NO: 5203 - protein, 33 aa, synthetic construct
  REGION 1..33: note = Synthetic
AATVAESVLNSVKSMNDEYHATIEEDQVISISS

SEQ ID NO: 5204 - protein, 12 aa, synthetic construct
  REGION 1..12: note = Synthetic
LWTLLQGGVHFM

SEQ ID NO: 5205 - protein, 39 aa, synthetic construct
  REGION 1..39: note = Synthetic
VSKATDCIEAGNYCGPTVMKICCGFCSPYSKICMNYPKN

SEQ ID NO: 5206 - protein, 39 aa, synthetic construct; identical to SEQ ID NO: 5205
  REGION 1..39: note = Synthetic

SEQ ID NO: 5207 - protein, 34 aa, synthetic construct
  REGION 1..34: note = Synthetic
RVAECFKDACNKSGLAPSMELILAEFIMESEADK

SEQ ID NO: 5208 - protein, 39 aa, synthetic construct
  REGION 1..39: note = Synthetic
AGELLQQLRGISAANIRFARRQQEAIRAPRPTPSRRRKR

SEQ ID NO: 5209 - protein, 23 aa, synthetic construct
  REGION 1..23: note = Synthetic
SGVAKKLNSAVDFRALARVLLKQ

SEQ ID NO: 5210 - protein, 32 aa, synthetic construct
  REGION 1..32: note = Synthetic
RQCADLGEECYTRFCCPGLRCKDLQVPTCLLA

SEQ ID NO: 5211 - protein, 39 aa, synthetic construct
  REGION 1..39: note = Synthetic
VSKAADCIEAGNYCGPTVMKLCCGFCSPYSKICMNYPKN

SEQ ID NO: 5212 - protein, 21 aa, synthetic construct
  REGION 1..21: note = Synthetic
SGGSGAAGGVGNLFSGILGGL

SEQ ID NO: 5213 - protein, 40 aa, synthetic construct
  REGION 1..40: note = Synthetic
YGGYGRGYGGYGGYGRGYGGYGRGMYGGYGRPYGGYGWGK

SEQ ID NO: 5214 - protein, 27 aa, synthetic construct
  REGION 1..27: note = Synthetic
ERVWEMCDYIWQNVTIPDVEPSDNWDV

SEQ ID NO: 5215 - protein, 22 aa, synthetic construct
  REGION 1..22: note = Synthetic
NQGSGFCDSIGNTSLCKCQYNC

SEQ ID NO: 5216 - protein, 18 aa, synthetic construct
  REGION 1..18: note = Synthetic
VGSCGSGLKSCCVRNRWA

SEQ ID NO: 5217 - protein, 23 aa, synthetic construct
  REGION 1..23: note = Synthetic
GHCIAKGFKGGYCNDKAVCVCRN

SEQ ID NO: 5218 - protein, 42 aa, synthetic construct
  REGION 1..42: note = Synthetic
CLKSAAGAISGINLGKAAGLPSTCGVNIPYKISPSTDCSKVQ

SEQ ID NO: 5219 - protein, 31 aa, synthetic construct
  REGION 1..31: note = Synthetic
EKIASVASEAAEAVKIAVADTDGGSQEHEEL

SEQ ID NO: 5220 - protein, 30 aa, synthetic construct
  REGION 1..30: note = Synthetic
EAAQRVAKAASKIAEAKQVDAEILKKEVYI

SEQ ID NO: 5221 - protein, 24 aa, synthetic construct
  REGION 1..24: note = Synthetic
IYGGCYGNANNFKTIDECKRTCAA

SEQ ID NO: 5222 - protein, 24 aa, synthetic construct
  REGION 1..24: note = Synthetic
IYGGCYGNANNFKTIDECKRTCAA

SEQ ID NO: 5223 - protein, 41 aa, synthetic construct
  REGION 1..41: note = Synthetic
GGLVATLQSLGAGGSSVITGNIGALMGYATHKYLDSEEDEE

SEQ ID NO: 5224 - protein, 14 aa, synthetic construct
  REGION 1..14: note = Synthetic
DWVQEYITDLELNA

SEQ ID NO: 5225 - protein, 40 aa, synthetic construct; identical to SEQ ID NO: 4912
  REGION 1..40: note = Synthetic

SEQ ID NO: 5226 - protein, 41 aa, synthetic construct
  REGION 1..41: note = Synthetic
AAVTHLSQAISSVVAQVLPSAHIDAWEYCMAYIAAGIGAGL

SEQ ID NO: 5227 - protein, 41 aa, synthetic construct
  REGION 1..41: note = Synthetic
AAEAMGKFKQCFLNQSHRTLKNFGLMMHTVYDSIWCNMKSN

SEQ ID NO: 5228 - protein, 34 aa, synthetic construct
  REGION 1..34: note = Synthetic
SFISSMKTCVSKLSSPSLYVSFYVFALFVVVFIL

SEQ ID NO: 5229 - protein, 36 aa, synthetic construct
  REGION 1..36: note = Synthetic
AEVKGLLGQLEELAWNLPPGPFSPIPDLLGDGDDRF

SEQ ID NO: 5230 - protein, 18 aa, synthetic construct
  REGION 1..18: note = Synthetic
GRHAGAKCMNGKCHCSKI

SEQ ID NO: 5231 - protein, 37 aa, synthetic construct; identical to SEQ ID NO: 5116
  REGION 1..37: note = Synthetic

SEQ ID NO: 5232 - protein, 37 aa, synthetic construct; identical to SEQ ID NO: 5116
  REGION 1..37: note = Synthetic

SEQ ID NO: 5233 - protein, 15 aa, synthetic construct
  REGION 1..15: note = Synthetic
ADTIKNGFSAIFCAG

SEQ ID NO: 5234 - protein, 17 aa, synthetic construct
  REGION 1..17: note = Synthetic
FYSIASEAVYAVENPEH

SEQ ID NO: 5235 - protein, 14 aa, synthetic construct
  REGION 1..14: note = Synthetic
TCVKVLQSAAESRP

SEQ ID NO: 5236 - protein, 26 aa, synthetic construct
  REGION 1..26: note = Synthetic
WVTSCATGWHKCNSENELFHECCKQG

SEQ ID NO: 5237 - protein, 19 aa, synthetic construct
  REGION 1..19: note = Synthetic
TRAVSTLLQFATTVAGLIM

SEQ ID NO: 5238 - protein, 21 aa, synthetic construct
  REGION 1..21: note = Synthetic
LTGIKNAMSYIPSLLMGQEMK

SEQ ID NO: 5239 - protein, 25 aa, synthetic construct
  REGION 1..25: note = Synthetic
TGYAVYTAFGQPSKKLRDPFEEHED

SEQ ID NO: 5240 - protein, 25 aa, synthetic construct
  REGION 1..25: note = Synthetic
TGYTIYTAFGQPSKQLRDPFEEHED

SEQ ID NO: 5241 - protein, 35 aa, synthetic construct
  REGION 1..35: note = Synthetic
NGCDTIIEECKTSMVERCQNQEFESAAGSTTLGPQ

SEQ ID NO: 5242 - protein, 40 aa, synthetic construct
  REGION 1..40: note = Synthetic
SGIITPGGRLIQLPHGVSIILEGPSAALLSNGDFVTYESS

SEQ ID NO: 5243 - protein, 16 aa, synthetic construct
  REGION 1..16: note = Synthetic
IDEGGRGVCAIVPEHV

SEQ ID NO: 5244 - protein, 21 aa, synthetic construct
  REGION 1..21: note = Synthetic
RVKGLLASVAERENGHRTFKK

SEQ ID NO: 5245 - protein, 25 aa, synthetic construct
  REGION 1..25: note = Synthetic
TGYALYTAFGEPSKELRDPFEEHED

SEQ ID NO: 5246 - protein, 29 aa, synthetic construct
  REGION 1..29: note = Synthetic
AEQVVQGMKEAQVRLTGDAFREKHFQDEL

SEQ ID NO: 5247 - protein, 25 aa, synthetic construct
  REGION 1..25: note = Synthetic
TGYAIYTSFGRPSEQLRDPFEDHED

SEQ ID NO: 5248 - protein, 34 aa, synthetic construct
  REGION 1..34: note = Synthetic
KALEDFYRFINRERFVERRIITPRQTEACTSENA

SEQ ID NO: 5249 - protein, 25 aa, synthetic construct
  REGION 1..25: note = Synthetic
TGYAIYTSFGRPSEQLKDPFEDHED

SEQ ID NO: 5250 - protein, 31 aa, synthetic construct
  REGION 1..31: note = Synthetic
SGPGGMKNWVEWKLHCLGRPLSYWMTGCHLG

SEQ ID NO: 5251 - protein, 14 aa, synthetic construct
  REGION 1..14: note = Synthetic
KEFNGGAGGFRAAR

SEQ ID NO: 5252 - protein, 35 aa, synthetic construct
  REGION 1..35: note = Synthetic
ALQSLLDSAQTFAETDNNGASIFNGIRKLRTEHDK

SEQ ID NO: 5253 - protein, 23 aa, synthetic construct
  REGION 1..23: note = Synthetic
LNEVLSAFFDVEEPQEKGCIICF

SEQ ID NO: 5254 - protein, 38 aa, synthetic construct
  REGION 1..38: note = Synthetic
GDLVEGGCEKLLVLSDSNLPPFDKSPLLTQNREPVLLD

SEQ ID NO: 5255 - protein, 30 aa, synthetic construct
  REGION 1..30: note = Synthetic
RGVHGCDSYCKTKNFDYGYCRQEHCCCVNY

SEQ ID NO: 5256 - protein, 27 aa, synthetic construct
  REGION 1..27: note = Synthetic
QMTAAADQCWDDLPCPASHKSVCAMTF

SEQ ID NO: 5257 - protein, 15 aa, synthetic construct
  REGION 1..15: note = Synthetic
ADTIKNGFSAIFCAG

SEQ ID NO: 5258 - protein, 25 aa, synthetic construct
  REGION 1..25: note = Synthetic
CNYASTLINSVITTAVCVFAVFIFL

SEQ ID NO: 5259 - protein, 24 aa, synthetic construct
  REGION 1..24: note = Synthetic
DYFHTLVNNWLANNPYLGTGADRD

SEQ ID NO: 5260 - protein, 32 aa, synthetic construct
  REGION 1..32: note = Synthetic
RGMWGECKDGLTTCLAPSECCSEDCEGSCTMW

SEQ ID NO: 5261 - protein, 29 aa, synthetic construct
  REGION 1..29: note = Synthetic
KAINGAQRLAEKAEDAAAASTDAINSAAF

SEQ ID NO: 5262 - protein, 37 aa, synthetic construct
  REGION 1..37: note = Synthetic
AKAAMTELKSCRDGLQPMHKAELVKLLVQVLGSQDGA

SEQ ID NO: 5263 - protein, 23 aa, synthetic construct
  REGION 1..23: note = Synthetic
IYGYCGSGAAYCGAGNCRCQCRG

SEQ ID NO: 5264 - protein, 28 aa, synthetic construct
  REGION 1..28: note = Synthetic
RDGCSNAGGFCGIHPGLCCSEICLVWCT

SEQ ID NO: 5265 - protein, 27 aa, synthetic construct
  REGION 1..27: note = Synthetic
DSCAEEGEECCSDLRCMTSGAGAICVT

SEQ ID NO: 5266 - protein, 34 aa, synthetic construct
  REGION 1..34: note = Synthetic
TSAMDQLTNGMAVELGRVQATYEEADPSHCASGV

SEQ ID NO: 5267 - protein, 38 aa, synthetic construct
  REGION 1..38: note = Synthetic
KAMQGVFEYYKSVTFVSNCGSHPSTTSKGSPINTQYVF

SEQ ID NO: 5268 - protein, 15 aa, synthetic construct
  REGION 1..15: note = Synthetic
QCCDDFCSTATSTCI

SEQ ID NO: 5269 - protein, 15 aa, synthetic construct
  REGION 1..15: note = Synthetic
QCCDDFCSTATSTCI

SEQ ID NO: 5270 - protein, 34 aa, synthetic construct
  REGION 1..34: note = Synthetic
KDILYYCDSAAQHIGGDELNYYCKQNGAGDSVAW

SEQ ID NO: 5271 - protein, 28 aa, synthetic construct
  REGION 1..28: note = Synthetic
HQADAAAAAATKTANNPTDAKLAGAGSP

SEQ ID NO: 5272 - protein, 41 aa, synthetic construct
  REGION 1..41: note = Synthetic
YETCLQYVDRAWIHYSDSEFCGCTNPEQESAFRDAMDCLQF

SEQ ID NO: 5273 - protein, 42 aa, synthetic construct
  REGION 1..42: note = Synthetic
TFGAGGPRLVNTLGGSSPTTKRVIYIVMILLVLITLAVNLKH

SEQ ID NO: 5274 - protein, 42 aa, synthetic construct; identical to SEQ ID NO: 5273
  REGION 1..42: note = Synthetic

SEQ ID NO: 5275 - protein, 25 aa, synthetic construct
  REGION 1..25: note = Synthetic
TGYALYTAFGQPSRELRDPFEEHED

SEQ ID NO: 5276 - protein, 25 aa, synthetic construct
  REGION 1..25: note = Synthetic
TGYALYTAFGQPSRELRDPFEEHED

SEQ ID NO: 5277 - protein, 24 aa, synthetic construct
  REGION 1..24: note = Synthetic
EAMNLLTYMLHGLSRRKHILRWLE

SEQ ID NO: 5278 - protein, 31 aa, synthetic construct
  REGION 1..31: note = Synthetic
RAFAATLVTAAECNLSSVQAPGVRLVLLADG

SEQ ID NO: 5279 - protein, 39 aa, synthetic construct
  REGION 1..39: note = Synthetic
AGDLLQKLRDISAAKLQFVRLRPELTREAIPAHSRRRKR

SEQ ID NO: 5280 - protein, 25 aa, synthetic construct
  REGION 1..25: note = Synthetic
TGYALYTAFGQPSKQLRDPFEDHED

SEQ ID NO: 5281 - protein, 25 aa, synthetic construct
  REGION 1..25: note = Synthetic
TGYALYTAFGQPSKQLRDPFEDHED

SEQ ID NO: 5282 - protein, 25 aa, synthetic construct
  REGION 1..25: note = Synthetic
TGYALYTAFGQPSKELRDPFEEHED

SEQ ID NO: 5283 - protein, 25 aa, synthetic construct
  REGION 1..25: note = Synthetic
TGYALYTAFGQPSKELRDPFEEHED

SEQ ID NO: 5284 - protein, 25 aa, synthetic construct
  REGION 1..25: note = Synthetic
TGYALYTAFGQPSKELRDPFEEHED

SEQ ID NO: 5285 - protein, 25 aa, synthetic construct
  REGION 1..25: note = Synthetic
TGYALYTAFGQPSKELRDPFEEHED

SEQ ID NO: 5286 - protein, 25 aa, synthetic construct
  REGION 1..25: note = Synthetic
TGYALYTAFGQPSKELRDPFEEHED

SEQ ID NO: 5287 - protein, 25 aa, synthetic construct
  REGION 1..25: note = Synthetic
TGYALYTAFGQPSKELRDPFEEHED

SEQ ID NO: 5288 - protein, 25 aa, synthetic construct
  REGION 1..25: note = Synthetic
TGYALYTAFGQPSKELRDPFEEHED

SEQ ID NO: 5289 - protein, 25 aa, synthetic construct
  REGION 1..25: note = Synthetic
TGYALYTAFGQPSKELRDPFEEHED

SEQ ID NO: 5290 - protein, 25 aa, synthetic construct
  REGION 1..25: note = Synthetic
TGYALYTAFGQPSKELRDPFEEHED

SEQ ID NO: 5291 - protein, 25 aa, synthetic construct
  REGION 1..25: note = Synthetic
TGYALYTAFGQPSKELRDPFEEHED

SEQ ID NO: 5292 - protein, 25 aa, synthetic construct
  REGION 1..25: note = Synthetic
TGYALYTAFGQPSKELRDPFEEHED

SEQ ID NO: 5293 - protein, 41 aa, synthetic construct
  REGION 1..41: note = Synthetic
HWVGGGGTSVSSFKGMFFVRHCIYELVFVCVWESMSNWLQK

SEQ ID NO: 5294 - protein, 27 aa, synthetic construct
  REGION 1..27: note = Synthetic
TGAGSSLAGCIAGPNGLLFTVGAGASV

SEQ ID NO: 5295 - protein, 33 aa, synthetic construct
  REGION 1..33: note = Synthetic
VKRACHTCDDGTECCDSRCSCPWNTCTCIPWGK

SEQ ID NO: 5296 - protein, 39 aa, synthetic construct
  REGION 1..39: note = Synthetic
DLIRAALEDADTKNDPRLLGLVTGACCAVLKFSFCCGKK

SEQ ID NO: 5297 - protein, 42 aa, synthetic construct
  REGION 1..42: note = Synthetic
NVLRALRRLGSSKMMRDSRCFGRRLDRIGSLSGLGCNVLRRH

SEQ ID NO: 5298 - protein, 26 aa, synthetic construct
  REGION 1..26: note = Synthetic
DNAKRILQTLRNTRSCCPEEPCCFWR

SEQ ID NO: 5299 - protein, 37 aa, synthetic construct
  REGION 1..37: note = Synthetic
DRASDGGNAAASDLIALTIKGCCSRPPCALSNPDYCG

SEQ ID NO: 5300 - protein, 27 aa, synthetic construct
  REGION 1..27: note = Synthetic
DNAKRFLQTLRNTRSCCPEEITCCPWG

SEQ ID NO: 5301 - protein, 33 aa, synthetic construct; identical to SEQ ID NO: 5150
  REGION 1..33: note = Synthetic

SEQ ID NO: 5302 - protein, 42 aa, synthetic construct
  REGION 1..42: note = Synthetic
SALGNLEGVMEASLYSTEVVTLTRLQKSLYVMLQQLDLIHGC

SEQ ID NO: 5303 - protein, 16 aa, synthetic construct
  REGION 1..16: note = Synthetic
LLNLLAGLGAMGARRP

SEQ ID NO: 5304 - protein, 33 aa, synthetic construct
  REGION 1..33: note = Synthetic
SGYCQWGGRYGNACWCIKLPDDVPIRVPGKCHR

SEQ ID NO: 5305 - protein, 31 aa, synthetic construct
  REGION 1..31: note = Synthetic
HLLRNMIEMARNENQREQAGLNRKYLDEVGK

SEQ ID NO: 5306 - protein, 29 aa, synthetic construct
  REGION 1..29: note = Synthetic
ADEVQEVADDAGQAVEDAEKSADDVVDEA

SEQ ID NO: 5307 - protein, 33 aa, synthetic construct
  REGION 1..33: note = Synthetic
SGYCQWGGKYGNACWCIKLPDDVPIRVPGKCHR

SEQ ID NO: 5308 - protein, 24 aa, synthetic construct
  REGION 1..24: note = Synthetic
IYGGCYGNANNFKTIDECEPPCAA

SEQ ID NO: 5309 - protein, 25 aa, synthetic construct
  REGION 1..25: note = Synthetic
TGYALYTSFGRPSEGLIDPFDNHED

SEQ ID NO: 5310 - protein, 18 aa, synthetic construct
  REGION 1..18: note = Synthetic
QYGNQYVSQYSAPRSSGY

SEQ ID NO: 5311 - protein, 36 aa, synthetic construct
  REGION 1..36: note = Synthetic
ADQVTRVITGVPWYSSRLKPAISSALSADGIYTIAN

SEQ ID NO: 5312 - protein, 42 aa, synthetic construct
  REGION 1..42: note = Synthetic
CLKSAASSFTDLDLGKAASLPSTCNVNIPYKISPSTDCSKVQ

SEQ ID NO: 5313 - protein, 12 aa, synthetic construct
  REGION 1..12: note = Synthetic
GLLDGLLGTLGL

SEQ ID NO: 5314 - protein, 12 aa, synthetic construct
  REGION 1..12: note = Synthetic
GLLDGLLGTLGL

SEQ ID NO: 5315 - protein, 12 aa, synthetic construct
  REGION 1..12: note = Synthetic
GLLDGLLGTLGL

SEQ ID NO: 5316 - protein, 12 aa, synthetic construct
  REGION 1..12: note = Synthetic
GLLDGLLGTLGL

SEQ ID NO: 5317 - protein, 35 aa, synthetic construct
  REGION 1..35: note = Synthetic
AACHSILTSCRVDTDCCAGLKCGIFDEDALCVPQG

SEQ ID NO: 5318 - protein, 33 aa, synthetic construct
  REGION 1..33: note = Synthetic
RGCGTMWSPCSTEKPCCDNFSCQPAIKWCIWSP

SEQ ID NO: 5319 - protein, 19 aa, synthetic construct
  REGION 1..19: note = Synthetic
EEYQKMLENLREAEVKKNA

SEQ ID NO: 5320 - protein, 36 aa, synthetic construct
  REGION 1..36: note = Synthetic
AEQVTRVITGVPWYSTRLRPAISSALSKDGIYTIAN

SEQ ID NO: 5321 - protein, 20 aa, synthetic construct
  REGION 1..20: note = Synthetic
LAEEAKTLAAALLEEEIMDN

SEQ ID NO: 5322 - protein, 29 aa, synthetic construct
  REGION 1..29: note = Synthetic
TDYSDCIHEAIKTNYCTKPQKSYVVGFSI

SEQ ID NO: 5323 - protein, 29 aa, synthetic construct
  REGION 1..29: note = Synthetic
TDYSDCIHEAIKTNYCTKPQKSYMVGFSI

SEQ ID NO: 5324 - protein, 19 aa, synthetic construct
  REGION 1..19: note = Synthetic
GGSCIGFIDQGYMCVCKVG

SEQ ID NO: 5325 - protein, 33 aa, synthetic construct
  REGION 1..33: note = Synthetic
SGGSALMAKIGAFLGYTVHKQVESRQKESKEKK

SEQ ID NO: 5326 - protein, 41 aa, synthetic construct
  REGION 1..41: note = Synthetic
GGLVATLQSLGAGGSSVVIGNIGALMGYATHKYLDSEEDEE

SEQ ID NO: 5327 - protein, 40 aa, synthetic construct
  REGION 1..40: note = Synthetic
EIVKQLLTRGTLKDADFWKRLEMQGCVCNANAKFCCGEGR

SEQ ID NO: 5328 - protein, 42 aa, synthetic construct
  REGION 1..42: note = Synthetic
NRISTGVSTGISTTMNARVAVLITAAILSAPVTAIALLEARR

SEQ ID NO: 5329 - protein, 37 aa, synthetic construct
  REGION 1..37: note = Synthetic
GRGYGGRGGGWGGRGGGWGRGGGGRGFYGGGRRGWGK

SEQ ID NO: 5330 - protein, 33 aa, synthetic construct
  REGION 1..33: note = Synthetic
TQAQSFLDEVIKCANSSQIVLFSMLVALVFIII

SEQ ID NO: 5331 - protein, 27 aa, synthetic construct
  REGION 1..27: note = Synthetic
CKSWEGAAHGACHVRNGKHMCFCYFNC

SEQ ID NO: 5332 - protein, 12 aa, synthetic construct
  REGION 1..12: note = Synthetic
GLLDGLLGGLGL

SEQ ID NO: 5333 - protein, 12 aa, synthetic construct
  REGION 1..12: note = Synthetic
GLLDGLLGGLGL

SEQ ID NO: 5334 - protein, 18 aa, synthetic construct
  REGION 1..18: note = Synthetic
RCHQFAEGIWQGQCVETS

SEQ ID NO: 5335 - protein, 17 aa, synthetic construct
  REGION 1..17: note = Synthetic
VTEIAQSLATCVNDEQS

SEQ ID NO: 5336 - protein, 33 aa, synthetic construct
  REGION 1..33: note = Synthetic
AERCSNFGSDCIPATHDCCSGECFGFEDMGLCT

SEQ ID NO: 5337 - protein, 40 aa, synthetic construct
  REGION 1..40: note = Synthetic
GYGGGYGGGYGDVGYGGGYSGGYSGGYSGGYGSYGHRRKY

SEQ ID NO: 5338 - protein, 11 aa, synthetic construct
  REGION 1..11: note = Synthetic
GHGGYGGGLGY

SEQ ID NO: 5339 - protein, 24 aa, synthetic construct
  REGION 1..24: note = Synthetic
IYGGCGGNANNFKTLEECESTCAA

SEQ ID NO: 5340 - protein, 39 aa, synthetic construct
  REGION 1..39: note = Synthetic
AGELLQQLRDISAAKSHFARRQQVAVRELRPTHSRRWKR

SEQ ID NO: 5341 - protein, 28 aa, synthetic construct
  REGION 1..28: note = Synthetic
DEMNTVLDSLATRDFINWLLQTKITDRK

SEQ ID NO: 5342 - protein, 31 aa, synthetic construct; identical to SEQ ID NO: 5075
  REGION 1..31: note = Synthetic

SEQ ID NO: 5343 - protein, 23 aa, synthetic construct
  REGION 1..23: note = Synthetic
GFGCYRSCWKAGHDEETCKKECS

SEQ ID NO: 5344 - protein, 12 aa, synthetic construct
  REGION 1..12: note = Synthetic
GAVSGLLTNLGL

SEQ ID NO: 5345 - protein, 40 aa, synthetic construct
  REGION 1..40: note = Synthetic
AGILTMGRRAGAEPAPRPCPGRRCPVVAVPSAAPGGRSGV

SEQ ID NO: 5346 - protein, 40 aa, synthetic construct
  REGION 1..40: note = Synthetic
AGILTMGRRAGAEPAPRPCLGRRCSAPAAASVAPGGQSGI

SEQ ID NO: 5347 - protein, 22 aa, synthetic construct
  REGION 1..22: note = Synthetic
AAVTTYAGIITDQVFSVLSGKD

SEQ ID NO: 5348 - protein, 24 aa, synthetic construct
  REGION 1..24: note = Synthetic
ATSIVNSLKTALTQRNSYKEYAII

SEQ ID NO: 5349 - protein, 37 aa, synthetic construct
  REGION 1..37: note = Synthetic
ADQVTRVITGVPWYSTRLRPAISSALSKDGIYTAVPN

SEQ ID NO: 5350 - protein, 34 aa, synthetic construct
  REGION 1..34: note = Synthetic
RAAAEECEEYCEEEEKTCCGEEDGEPVCAEFCLG

SEQ ID NO: 5351 - protein, 17 aa, synthetic construct
  REGION 1..17: note = Synthetic
KCCRNGCGKVSCVTPVF

SEQ ID NO: 5352 - protein, 32 aa, synthetic construct
  REGION 1..32: note = Synthetic
KAAKAVLDAAPADKFKLMDESFKVAVMQVIAS

SEQ ID NO: 5353 - protein, 13 aa, synthetic construct
  REGION 1..13: note = Synthetic
VGGLVGGLLGRAL

SEQ ID NO: 5354 - protein, 33 aa, synthetic construct
  REGION 1..33: note = Synthetic
VITSLFNYVNSCASSIVGSLTPSLPNCVSTGSI

SEQ ID NO: 5355 - protein, 25 aa, synthetic construct
  REGION 1..25: note = Synthetic
TGYALYTAFGQPSQKLRDPFEEHGD

SEQ ID NO: 5356 - protein, 25 aa, synthetic construct
  REGION 1..25: note = Synthetic
TGYALYTAFGQPSQKLRDPFEEHGD

SEQ ID NO: 5357 - protein, 40 aa, synthetic construct
  REGION 1..40: note = Synthetic
GNGAYASITNGGPGNQNVTIRLKSQRGHGINFVIEIYSRY

SEQ ID NO: 5358 - protein, 13 aa, synthetic construct
  REGION 1..13: note = Synthetic
VGGIVGGLLGRAL

SEQ ID NO: 5359 - protein, 32 aa, synthetic construct
  REGION 1..32: note = Synthetic
RQCADLGEECHTRFCCPGLRCEDLQVPTCLMA

SEQ ID NO: 5360 - protein, 41 aa, synthetic construct
  REGION 1..41: note = Synthetic
QNLKGAMATGSGSNLKLRRSEMPADPYHVTICKIWGEESSS

SEQ ID NO: 5361 - protein, 29 aa, synthetic construct
  REGION 1..29: note = Synthetic
CYTGYNGVGECFDDPNVPGPDNCGCRYNC

SEQ ID NO: 5362 - protein, 34 aa, synthetic construct
  REGION 1..34: note = Synthetic
TMESIVNTVANPEASTVSINTPETTTVPVSSTAA

SEQ ID NO: 5363 - protein, 31 aa, synthetic construct
  REGION 1..31: note = Synthetic
EQLENGGTSLSEKTVVLLVTLLLAAAWCLHP

SEQ ID NO: 5364 - protein, 42 aa, synthetic construct; identical to SEQ ID NO: 5139
  REGION 1..42: note = Synthetic

SEQ ID NO: 5365 - protein, 42 aa, synthetic construct; identical to SEQ ID NO: 5139
  REGION 1..42: note = Synthetic

SEQ ID NO: 5366 - protein, 40 aa, synthetic construct
  REGION 1..40: note = Synthetic
RNGHDYYGDYYQRHYDEDAAIGPHSRESFRHGASVNYNDY

SEQ ID NO: 5367 - protein, 21 aa, synthetic construct
  REGION 1..21: note = Synthetic
LRDYANRVINGGPVEAAGPPA

SEQ ID NO: 5368 - protein, 20 aa, synthetic construct
  REGION 1..20: note = Synthetic
EAAEAYGTCFRGEAKKHGLL

SEQ ID NO: 5369 - protein, 31 aa, synthetic construct; identical to SEQ ID NO: 5305
  REGION 1..31: note = Synthetic

SEQ ID NO: 5370 - protein, 34 aa, synthetic construct
  REGION 1..34: note = Synthetic
TAMAIFRKLARERNYTDEMVAVLPSQEECSVDEV

SEQ ID NO: 5371 - protein, 29 aa, synthetic construct
  REGION 1..29: note = Synthetic
TDYSDCIHEAIKTNDCTKPQKSDVVGVSI

SEQ ID NO: 5372 - protein, 28 aa, synthetic construct
  REGION 1..28: note = Synthetic
TGYALYTAFGQPSQQLRDPFEEHGNELK

SEQ ID NO: 5373 - protein, 28 aa, synthetic construct
  REGION 1..28: note = Synthetic
TGYALYTAFGQPSQQLRDPFEEHGNELK

SEQ ID NO: 5374 - protein, 29 aa, synthetic construct
  REGION 1..29: note = Synthetic
TDYSDCIHEAIKTNYCTKPQKSYVLEFSI

SEQ ID NO: 5375 - protein, 29 aa, synthetic construct
  REGION 1..29: note = Synthetic
TDYSDCIHEAIKTNYCTKPQKSYLVGFSV

SEQ ID NO: 5376 - protein, 32 aa, synthetic construct
  REGION 1..32: note = Synthetic
YGGCGGNANNFHTLEECEKVCGVRSRDSPKEN

SEQ ID NO: 5377 - protein, 36 aa, synthetic construct
  REGION 1..36: note = Synthetic
LASGFGVGSSLCAAHCIARRYRGGYCNSKAVCVCRN

SEQ ID NO: 5378 - protein, 25 aa, synthetic construct
  REGION 1..25: note = Synthetic
GGGYGGGGGYGGGYGGGYGGGKYKG

SEQ ID NO: 5379 - protein, 25 aa, synthetic construct
  REGION 1..25: note = Synthetic
RRAEEWGRSGQDPDHFRPAGLPKKY

SEQ ID NO: 5380 - protein, 15 aa, synthetic construct
  REGION 1..15: note = Synthetic
NALSVLDKIYTSPLC

SEQ ID NO: 5381 - protein, 27 aa, synthetic construct
  REGION 1..27: note = Synthetic
AANIFRALRSISQEDCELCINVACTGC

SEQ ID NO: 5382 - protein, 18 aa, synthetic construct
  REGION 1..18: note = Synthetic
KARTAVDYICSELYDKAW

SEQ ID NO: 5383 - protein, 25 aa, synthetic construct
  REGION 1..25: note = Synthetic
TGYALYTAFGQPSEQLRDPFEEHED

SEQ ID NO: 5384 - protein, 25 aa, synthetic construct
  REGION 1..25: note = Synthetic
TGYALYTAFGQPSEQLRDPFEEHED

SEQ ID NO: 5385 - protein, 25 aa, synthetic construct
  REGION 1..25: note = Synthetic
TGYALYTAFGQPSEQLRDPFEEHED

SEQ ID NO: 5386 - protein, 25 aa, synthetic construct
  REGION 1..25: note = Synthetic
TGYALYTAFGQPSEQLRDPFEEHED

SEQ ID NO: 5387 - protein, 25 aa, synthetic construct
  REGION 1..25: note = Synthetic
TGYALYTAFGQPSEQLRDPFEEHED

SEQ ID NO: 5388 - protein, 25 aa, synthetic construct
  REGION 1..25: note = Synthetic
TGYALYTAFGQPSEQLRDPFEEHED

SEQ ID NO: 5389 - protein, 25 aa, synthetic construct
  REGION 1..25: note = Synthetic
TGYALYTAFGQPSEQLRDPFEEHED

SEQ ID NO: 5390 - protein, 25 aa, synthetic construct
  REGION 1..25: note = Synthetic
TGYALYTAFGQPSEQLRDPFEEHED

SEQ ID NO: 5391 - protein, 25 aa, synthetic construct
  REGION 1..25: note = Synthetic
TGYALYTAFGQPSEQLRDPFEEHED

SEQ ID NO: 5392 - protein, 29 aa, synthetic construct
  REGION 1..29: note = Synthetic
ATSLASSIQSFASSVFLAAFFACSFIYMF

SEQ ID NO: 5393 - protein, 35 aa, synthetic construct
  REGION 1..35: note = Synthetic
RNAAAKASDLIALNARRPECCTHPACHVSNPELCG

SEQ ID NO: 5394 - protein, 13 aa, synthetic construct
  REGION 1..13: note = Synthetic
NGVYDQLGGCGAA

SEQ ID NO: 5395 - protein, 23 aa, synthetic construct
  REGION 1..23: note = Synthetic
MVALFAALFTGILALRLGTELYK

SEQ ID NO: 5396 - protein, 25 aa, synthetic construct
  REGION 1..25: note = Synthetic
KDGQTVLGTLDSKRLSPGGPDPRHH

SEQ ID NO: 5397 - protein, 42 aa, synthetic construct
  REGION 1..42: note = Synthetic
CESVAGRCIHNGCWCERSAPHGNCCNTSGCTARWWCPGTKWD

SEQ ID NO: 5398 - protein, 20 aa, synthetic construct
  REGION 1..20: note = Synthetic
TIIECAQKALTFWTYQNAQE

SEQ ID NO: 5399 - protein, 31 aa, synthetic construct
  REGION 1..31: note = Synthetic
AKSASNAASDAMEDAKDATKSWADWVKDKFD

SEQ ID NO: 5400 - protein, 16 aa, synthetic construct
  REGION 1..16: note = Synthetic
GRSGYAYCSGGGMYCN

SEQ ID NO: 5401 - protein, 27 aa, synthetic construct
  REGION 1..27: note = Synthetic
RKGFGLISQMFKLSCCADPACKHTPGC

SEQ ID NO: 5402 - protein, 31 aa, synthetic construct
  REGION 1..31: note = Synthetic
EQLESGGTSLSEKTVVLLVTPLLAAAWCLHP

SEQ ID NO: 5403 - protein, 20 aa, synthetic construct
  REGION 1..20: note = Synthetic
GNQFTALINALDCSPVNVNL

SEQ ID NO: 5404 - protein, 39 aa, synthetic construct
  REGION 1..39: note = Synthetic
DKARAAIESIKQSDIPAKTRNWFSETFHKVKEQLKTAFS

SEQ ID NO: 5405 - protein, 18 aa, synthetic construct
  REGION 1..18: note = Synthetic
RCIDEGGSGVCAIVPVLN

SEQ ID NO: 5406 - protein, 17 aa, synthetic construct
  REGION 1..17: note = Synthetic
KCCKNGCGFMTCTTARP

SEQ ID NO: 5407 - protein, 41 aa, synthetic construct
  REGION 1..41: note = Synthetic
MKDFTTYLSTAPVVAAAWFTFTAGLLIEINRFFPDPLAFSF

SEQ ID NO: 5408 - protein, 37 aa, synthetic construct
  REGION 1..37: note = Synthetic
ADQVTRVITGVPWYSTRLRPAISSALSADGIYTAVPN

SEQ ID NO: 5409 - protein, 29 aa, synthetic construct
  REGION 1..29: note = Synthetic
DCDRVAANCFAGAPYNNDNFFISFKENCQ

SEQ ID NO: 5410 - protein, 17 aa, synthetic construct
  REGION 1..17: note = Synthetic
GGGYGGGGYGGNGFFGK

SEQ ID NO: 5411 - protein, 32 aa, synthetic construct; identical to SEQ ID NO: 5376
  REGION 1..32: note = Synthetic

SEQ ID NO: 5412 - protein, 40 aa, synthetic construct
  REGION 1..40: note = Synthetic
GLYGGYGGFGGYGYRPFSYGYNPFSYGYYGFGDDDGGFDD

SEQ ID NO: 5413 - protein, 37 aa, synthetic construct
  REGION 1..37: note = Synthetic
GGGGGAQYPDGYSGRLPGGTYLHNKDCVGCSISGGGD

SEQ ID NO: 5414 - protein, 13 aa, synthetic construct
  REGION 1..13: note = Synthetic
TWVQEYVNDLELN

SEQ ID NO: 5415 - protein, 35 aa, synthetic construct
  REGION 1..35: note = Synthetic
TGGSSAAKSGSSSGAGFAPVAGAGSLAAIAGLLLL

SEQ ID NO: 5416 - protein, 41 aa, synthetic construct
  REGION 1..41: note = Synthetic
DAVGFADAVGEADPIDWKKVDWKKVSKKTCKVMLKACKFLG

SEQ ID NO: 5417 - protein, 36 aa, synthetic construct
  REGION 1..36: note = Synthetic
EEAAGLCEEGNEECVERRMLRDAHLDYIYTQKRNRP

SEQ ID NO: 5418 - protein, 41 aa, synthetic construct
  REGION 1..41: note = Synthetic
ITQAVACAKTIVSRQGITAWVAWKNKCRNRDVSSYIRGCKL

SEQ ID NO: 5419 - protein, 21 aa, synthetic construct
  REGION 1..21: note = Synthetic
ATGMCTSIPSLKDCYCMHQCP

SEQ ID NO: 5420 - protein, 35 aa, synthetic construct
  REGION 1..35: note = Synthetic
AVLSAGTRYLQWNDKKCTLLHPFLCQFQPRSEANG

SEQ ID NO: 5421 - protein, 24 aa, synthetic construct
  REGION 1..24: note = Synthetic
IYGGCYGNANNFKTIEECKRTCAA

SEQ ID NO: 5422 - protein, 37 aa, synthetic construct
  REGION 1..37: note = Synthetic
MKYFTTYLSTAPVVAVLWFTLTASLLIEINRFFPDIL

SEQ ID NO: 5423 - protein, 33 aa, synthetic construct
  REGION 1..33: note = Synthetic
CGSDYITYGNECHLCTESLKSNGRVQFLHDGSC

SEQ ID NO: 5424 - protein, 27 aa, synthetic construct
  REGION 1..27: note = Synthetic
IEDMARTFFAHFPLGSTLGFHVPYQED

SEQ ID NO: 5425 - protein, 29 aa, synthetic construct
  REGION 1..29: note = Synthetic
GGCSAGQTCCKHLVCSRRHGWCVWDGTFS

SEQ ID NO: 5426 - protein, 28 aa, synthetic construct
  REGION 1..28: note = Synthetic
GKTVRNIYDAGVIQLAGSFPGEGRDCLH

SEQ ID NO: 5427 - protein, 33 aa, synthetic construct
  REGION 1..33: note = Synthetic
SGYCQWGGKYGNACWCIKLPDSVPIRVPGKCQR

SEQ ID NO: 5428 - protein, 35 aa, synthetic construct
  REGION 1..35: note = Synthetic
RVVTEACEEYCEDRDKKTCCGLENGEPFCATLCFG

SEQ ID NO: 5429 - protein, 33 aa, synthetic construct
  REGION 1..33: note = Synthetic
DDLYAIAAHILTQPQIQAEKWGGGKIYYTKRSM

SEQ ID NO: 5430 - protein, 21 aa, synthetic construct
  REGION 1..21: note = Synthetic
SGSQAAKHLMGLAAANYAGGP

SEQ ID NO: 5431 - protein, 30 aa, synthetic construct
  REGION 1..30: note = Synthetic
SGSQAAKHLMGLAAANYAGGPGRRRRSEQA

SEQ ID NO: 5432 - protein, 21 aa, synthetic construct
  REGION 1..21: note = Synthetic
SGSQAAKHLMGLAAANYAGGP

SEQ ID NO: 5433 - protein, 21 aa, synthetic construct
  REGION 1..21: note = Synthetic
SGSQAAKHLMGLAAANYAGGP

SEQ ID NO: 5434 - protein, 25 aa, synthetic construct
  REGION 1..25: note = Synthetic
TGYALYTAFGQPSEQLRDPFEEHGD

SEQ ID NO: 5435 - protein, 25 aa, synthetic construct
  REGION 1..25: note = Synthetic
TGYALYTAFGQPSEQLRDPFEEHGD

SEQ ID NO: 5436 - protein, 28 aa, synthetic construct
  REGION 1..28: note = Synthetic
DEMNTVLDTLATRDFINWLLQTKITDRK

SEQ ID NO: 5437 - protein, 42 aa, synthetic construct
  REGION 1..42: note = Synthetic
LKSGFSCCHRYGGIGYVEGYKTVDPVTCQHESYRLDDPSQRS

SEQ ID NO: 5438 - protein, 39 aa, synthetic construct
  REGION 1..39: note = Synthetic
SCDGGGGALGHPRVYINLDKETKTGTCGYCGLQFRQQHH

SEQ ID NO: 5439 - protein, 40 aa, synthetic construct
  REGION 1..40: note = Synthetic
RNGHEYYGDYYQRHYDEDSAIGPRSPYGFRHGASVNYDDY

SEQ ID NO: 5440 - protein, 24 aa, synthetic construct
  REGION 1..24: note = Synthetic
AIASHILTQAQIQAEKWGGGKIYY

SEQ ID NO: 5441 - protein, 27 aa, synthetic construct
  REGION 1..27: note = Synthetic
AGGYCKPGNTCCCKKKDSGPVDVPPTA

SEQ ID NO: 5442 - protein, 29 aa, synthetic construct
  REGION 1..29: note = Synthetic
TKVDTMVTTLRSFVEIESSKTLCEKIYLC

SEQ ID NO: 5443 - protein, 29 aa, synthetic construct
  REGION 1..29: note = Synthetic
TDYSDCIHEAIKANYCTKPQKSYVVEFSI

SEQ ID NO: 5444 - protein, 21 aa, synthetic construct
  REGION 1..21: note = Synthetic
AAMSTYAGIFTDQLLTLLRGE

SEQ ID NO: 5445 - protein, 24 aa, synthetic construct
  REGION 1..24: note = Synthetic
IYGGCYGNANNFKTIDECERTCAA

SEQ ID NO: 5446 - protein, 24 aa, synthetic construct
  REGION 1..24: note = Synthetic
IYGGCYGNANNFKTIDECERTCAA

SEQ ID NO: 5447 - protein, 29 aa, synthetic construct
  REGION 1..29: note = Synthetic
TDYSDCIQEAVKMNYCTKPQKPHVVGLSI

SEQ ID NO: 5448 - protein, 27 aa, synthetic construct
  REGION 1..27: note = Synthetic
ASIFQALRTIAGDDCELCVNVACTGCS

SEQ ID NO: 5449 - protein, 41 aa, synthetic construct
  REGION 1..41: note = Synthetic
CATCGGHLGHVFKGEGFATPTDERHCVNSVSLKFTPAASSL

SEQ ID NO: 5450 - protein, 26 aa, synthetic construct
  REGION 1..26: note = Synthetic
YNEGCEGIAARVEVSKNPNVCSYTSN

SEQ ID NO: 5451 - protein, 27 aa, synthetic construct
  REGION 1..27: note = Synthetic
IEDMARTFFAHFPLGSTLGFHVPYQED

SEQ ID NO: 5452 - protein, 25 aa, synthetic construct
  REGION 1..25: note = Synthetic
TGYALYTAFGQPSNELRDPFEEHED

SEQ ID NO: 5453 - protein, 27 aa, synthetic construct
  REGION 1..27: note = Synthetic
AGSAGGGSAGGDGPNNSLLSEFVYNNY

SEQ ID NO: 5454 - protein, 21 aa, synthetic construct
  REGION 1..21: note = Synthetic
IKEIHDAATACDPEAHHEHDH

SEQ ID NO: 5455 - protein, 25 aa, synthetic construct
  REGION 1..25: note = Synthetic
TGGADSVAAAAAVGGPILAALALLL

SEQ ID NO: 5456 - protein, 18 aa, synthetic construct
  REGION 1..18: note = Synthetic
ISLLTSALEYAKQVLPNR

SEQ ID NO: 5457 - protein, 30 aa, synthetic construct
  REGION 1..30: note = Synthetic
RTGEDFLEECMGGCAFDFCCKRSLRDTTSD

SEQ ID NO: 5458 - protein, 25 aa, synthetic construct
  REGION 1..25: note = Synthetic
TGYALYTAFGQPSEQLRDPFEEHED

SEQ ID NO: 5459 - protein, 25 aa, synthetic construct
  REGION 1..25: note = Synthetic
TGYALYTAFGQPSEQLRDPFEEHED

SEQ ID NO: 5460 - protein, 25 aa, synthetic construct
  REGION 1..25: note = Synthetic
TGYALYTAFGQPSEQLRDPFEEHED

SEQ ID NO: 5461 - protein, 25 aa, synthetic construct
  REGION 1..25: note = Synthetic
TGYALYTAFGQPSEQLRDPFEEHED

SEQ ID NO: 5462 - protein, 22 aa, synthetic construct
  REGION 1..22: note = Synthetic
AAVSTYAGIFTDQLLSMLKGDS

SEQ ID NO: 5463 - protein, 34 aa, synthetic construct
  REGION 1..34: note = Synthetic
GVSNGGTEMIQLSHIRERQRYWAQDNLRRRFLEK

SEQ ID NO: 5464 - protein, 41 aa, synthetic construct
  REGION 1..41: note = Synthetic
GGAAAAPAKGAAAARSPMASTTAVLVVAAAVAAPLLAFFHF

SEQ ID NO: 5465 - protein, 23 aa, synthetic construct
  REGION 1..23: note = Synthetic
YGGCGGNANNFKSGGECKRACGE

SEQ ID NO: 5466 - protein, 20 aa, synthetic construct
  REGION 1..20: note = Synthetic
ANEFTGLINALSCSPINVNL

SEQ ID NO: 5467 - protein, 22 aa, synthetic construct
  REGION 1..22: note = Synthetic
GHACYRNCWREGNDEETCKERC

SEQ ID NO: 5468 - protein, 23 aa, synthetic construct
  REGION 1..23: note = Synthetic
GHACYRNCWREGNDEETCKERCG

SEQ ID NO: 5469 - protein, 30 aa, synthetic construct
  REGION 1..30: note = Synthetic
HGNAIIDRGCSTSCPGGNRPVCCSTDLCNK

SEQ ID NO: 5470 - protein, 29 aa, synthetic construct
  REGION 1..29: note = Synthetic
LSAGAGSGLAGDHLSDISEPEPELDSRRH

SEQ ID NO: 5471 - protein, 25 aa, synthetic construct
  REGION 1..25: note = Synthetic
TGYALYTAFGQPSEQLRDPFEDHED

SEQ ID NO: 5472 - protein, 22 aa, synthetic construct
  REGION 1..22: note = Synthetic
TKADQLAQQAHNNRKLLDIAGK

SEQ ID NO: 5473 - protein, 21 aa, synthetic construct
  REGION 1..21: note = Synthetic
AAVSTYAGIFTDQLLTLLKGD

SEQ ID NO: 5474 - protein, 28 aa, synthetic construct
  REGION 1..28: note = Synthetic
ACAAGAVSICGHCAPTCGCGRAGLGGYY

SEQ ID NO: 5475 - protein, 24 aa, synthetic construct
  REGION 1..24: note = Synthetic
IYGGCYGNANNFKTIEECKRTCAA

SEQ ID NO: 5476 - protein, 24 aa, synthetic construct
  REGION 1..24: note = Synthetic
IYGGCYGNANNFKTIEECKRTCAA

SEQ ID NO: 5477 - protein, 24 aa, synthetic construct
  REGION 1..24: note = Synthetic
IYGGCYGNANNFKTIEECKRTCAA

SEQ ID NO: 5478 - protein, 34 aa, synthetic construct
  REGION 1..34: note = Synthetic
GGGGSCYHYCHGRCCSAAEAKALEATTAQVKPQN

SEQ ID NO: 5479 - protein, 16 aa, synthetic construct
  REGION 1..16: note = Synthetic
IKDFVDRLKAGQVRRE

SEQ ID NO: 5480 - protein, 34 aa, synthetic construct
  REGION 1..34: note = Synthetic
ANCARKYKGYGDCRPGDRPHDKKDSLFCFCNYPC

SEQ ID NO: 5481 - protein, 28 aa, synthetic construct
  REGION 1..28: note = Synthetic
QNGIDVAQKCCSTDCSSDYIKEICCPFD

SEQ ID NO: 5482 - protein, 24 aa, synthetic construct
  REGION 1..24: note = Synthetic
IQSILSSGGKRLGCIKIAASLKGR

SEQ ID NO: 5483 - protein, 27 aa, synthetic construct
  REGION 1..27: note = Synthetic
IEDMARTFFAHFPLGSTLGFHVPYQED

SEQ ID NO: 5484 - protein, 27 aa, synthetic construct
  REGION 1..27: note = Synthetic
KRCLASGETCWRDTSCCSFSCTNNVCF

SEQ ID NO: 5485 - protein, 27 aa, synthetic construct
  REGION 1..27: note = Synthetic
KRCLASGETCWRDTSCCSFSCTNNVCF

SEQ ID NO: 5486 - protein, 20 aa, synthetic construct
  REGION 1..20: note = Synthetic
ERLAYEATSIVNDVNLDHAY

SEQ ID NO: 5487 - protein, 25 aa, synthetic construct
  REGION 1..25: note = Synthetic
TGYALYTAFGQPSQQLRDPFEEHGD

SEQ ID NO: 5488 - protein, 25 aa, synthetic construct
  REGION 1..25: note = Synthetic
TGYALYTAFGQPSQQLRDPFEEHGD

SEQ ID NO: 5489 - protein, 25 aa, synthetic construct
  REGION 1..25: note = Synthetic
TGYALYTAFGQPSQQLRDPFEEHGD

SEQ ID NO: 5490 - protein, 25 aa, synthetic construct
  REGION 1..25: note = Synthetic
TGYALYTAFGQPSQQLRDPFEEHGD

SEQ ID NO: 5491 - protein, 25 aa, synthetic construct
  REGION 1..25: note = Synthetic
TGYALYTAFGQPSQQLRDPFEEHGD

SEQ ID NO: 5492 - protein, 25 aa, synthetic construct
  REGION 1..25: note = Synthetic
TGYALYTAFGQPSQQLRDPFEEHGD

SEQ ID NO: 5493 - protein, 25 aa, synthetic construct
  REGION 1..25: note = Synthetic
TGYALYTAFGQPSQQLRDPFEEHGD

SEQ ID NO: 5494 - protein, 25 aa, synthetic construct
  REGION 1..25: note = Synthetic
TGYALYTAFGQPSQQLRDPFEEHGD

SEQ ID NO: 5495 - protein, 25 aa, synthetic construct
  REGION 1..25: note = Synthetic
TGYALYTAFGQPSQQLRDPFEEHGD

SEQ ID NO: 5496 - protein, 25 aa, synthetic construct
  REGION 1..25: note = Synthetic
TGYALYTAFGQPSQQLRDPFEEHGD

SEQ ID NO: 5497 - protein, 25 aa, synthetic construct
  REGION 1..25: note = Synthetic
TGYALYTAFGQPSQQLRDPFEEHGD

SEQ ID NO: 5498 - protein, 25 aa, synthetic construct
  REGION 1..25: note = Synthetic
TGYALYTAFGQPSQQLRDPFEEHGD

SEQ ID NO: 5499 - protein, 25 aa, synthetic construct
  REGION 1..25: note = Synthetic
TGYALYTAFGQPSQQLRDPFEEHGD

SEQ ID NO: 5500 - protein, 25 aa, synthetic construct
  REGION 1..25: note = Synthetic
TGYALYTAFGQPSQQLRDPFEEHGD

SEQ ID NO: 5501 - protein, 25 aa, synthetic construct
  REGION 1..25: note = Synthetic
TGYALYTAFGQPSQQLRDPFEEHGD

SEQ ID NO: 5502 - protein, 25 aa, synthetic construct
  REGION 1..25: note = Synthetic
TGYALYTAFGQPSQQLRDPFEEHGD

SEQ ID NO: 5503 - protein, 25 aa, synthetic construct
  REGION 1..25: note = Synthetic
TGYALYTAFGQPSQQLRDPFEEHGD

SEQ ID NO: 5504 - protein, 25 aa, synthetic construct
  REGION 1..25: note = Synthetic
TGYALYTAFGQPSQQLRDPFEEHGD

SEQ ID NO: 5505 - protein, 25 aa, synthetic construct
  REGION 1..25: note = Synthetic
TGYALYTAFGQPSQQLRDPFEEHGD

SEQ ID NO: 5506 - protein, 25 aa, synthetic construct
  REGION 1..25: note = Synthetic
TGYALYTAFGQPSQQLRDPFEEHGD

SEQ ID NO: 5507 - protein, 25 aa, synthetic construct
  REGION 1..25: note = Synthetic
TGYALYTAFGQPSQQLRDPFEEHGD

SEQ ID NO: 5508 - protein, 25 aa, synthetic construct
  REGION 1..25: note = Synthetic
TGYALYTAFGQPSQQLRDPFEEHGD

SEQ ID NO: 5509 - protein, 25 aa, synthetic construct
  REGION 1..25: note = Synthetic
TGYALYTAFGQPSQQLRDPFEEHGD

SEQ ID NO: 5510 - protein, 25 aa, synthetic construct
  REGION 1..25: note = Synthetic
TGYALYTAFGQPSQQLRDPFEEHGD

SEQ ID NO: 5511 - protein, 25 aa, synthetic construct
  REGION 1..25: note = Synthetic
TGYALYTAFGQPSQQLRDPFEEHGD

SEQ ID NO: 5512 - protein, 25 aa, synthetic construct
  REGION 1..25: note = Synthetic
TGYALYTAFGQPSQQLRDPFEEHGD

SEQ ID NO: 5513 - protein, 25 aa, synthetic construct
  REGION 1..25: note = Synthetic
TGYALYTAFGQPSQQLRDPFEEHGD

SEQ ID NO: 5514 - protein, 25 aa, synthetic construct
  REGION 1..25: note = Synthetic
TGYALYTAFGQPSQQLRDPFEEHGD

SEQ ID NO: 5515 - protein, 25 aa, synthetic construct
  REGION 1..25: note = Synthetic
TGYALYTAFGQPSQQLRDPFEEHGD

SEQ ID NO: 5516 - protein, 25 aa, synthetic construct
  REGION 1..25: note = Synthetic
TGYALYTAFGQPSQQLRDPFEEHGD

SEQ ID NO: 5517 - protein, 25 aa, synthetic construct
  REGION 1..25: note = Synthetic
TGYALYTAFGQPSQQLRDPFEEHGD

SEQ ID NO: 5518 - protein, 25 aa, synthetic construct
  REGION 1..25: note = Synthetic
TGYALYTAFGQPSQQLRDPFEEHGD

SEQ ID NO: 5519 - protein, 25 aa, synthetic construct
  REGION 1..25: note = Synthetic
TGYALYTAFGQPSQQLRDPFEEHGD

SEQ ID NO: 5520 - protein, 25 aa, synthetic construct
  REGION 1..25: note = Synthetic
TGYALYTAFGQPSQQLRDPFEEHGD

SEQ ID NO: 5521 - protein, 25 aa, synthetic construct
  REGION 1..25: note = Synthetic
TGYALYTAFGQPSQQLRDPFEEHGD

SEQ ID NO: 5522 - protein, 25 aa, synthetic construct
  REGION 1..25: note = Synthetic
TGYALYTAFGQPSQQLRDPFEEHGD

SEQ ID NO: 5523 - protein, 25 aa, synthetic construct
  REGION 1..25: note = Synthetic
TGYALYTAFGQPSQQLRDPFEEHGD

SEQ ID NO: 5524 - protein, 25 aa, synthetic construct
  REGION 1..25: note = Synthetic
TGYALYTAFGQPSQQLRDPFEEHGD

SEQ ID NO: 5525 - protein, 25 aa, synthetic construct
  REGION 1..25: note = Synthetic
TGYALYTAFGQPSQQLRDPFEEHGD

SEQ ID NO: 5526 - protein, 25 aa, synthetic construct
  REGION 1..25: note = Synthetic
TGYALYTAFGQPSQQLRDPFEEHGD

SEQ ID NO: 5527 - protein, 25 aa, synthetic construct
  REGION 1..25: note = Synthetic
TGYALYTAFGQPSQQLRDPFEEHGD

SEQ ID NO: 5528 - protein, 25 aa, synthetic construct
  REGION 1..25: note = Synthetic
TGYALYTAFGQPSQQLRDPFEEHGD

SEQ ID NO: 5529 - protein, 25 aa, synthetic construct
  REGION 1..25: note = Synthetic
TGYALYTAFGQPSQQLRDPFEEHGD

SEQ ID NO: 5530 - protein, 25 aa, synthetic construct
  REGION 1..25: note = Synthetic
TGYALYTAFGQPSQQLRDPFEEHGD

SEQ ID NO: 5531 - protein, 25 aa, synthetic construct
  REGION 1..25: note = Synthetic
TGYALYTAFGQPSQQLRDPFEEHGD

SEQ ID NO: 5532 - protein, 25 aa, synthetic construct
  REGION 1..25: note = Synthetic
TGYALYTAFGQPSQQLRDPFEEHGD

SEQ ID NO: 5533 - protein, 25 aa, synthetic construct
  REGION 1..25: note = Synthetic
TGYALYTAFGQPSQQLRDPFEEHGD

SEQ ID NO: 5534 - protein, 25 aa, synthetic construct
  REGION 1..25: note = Synthetic
TGYALYTAFGQPSQQLRDPFEEHGD

SEQ ID NO: 5535 - protein, 25 aa, synthetic construct
  REGION 1..25: note = Synthetic
TGYALYTAFGQPSQQLRDPFEEHGD

SEQ ID NO: 5536 - protein, 25 aa, synthetic construct
  REGION 1..25: note = Synthetic
TGYALYTAFGQPSQQLRDPFEEHGD

SEQ ID NO: 5537 - protein, 25 aa, synthetic construct
  REGION 1..25: note = Synthetic
TGYALYTAFGQPSQQLRDPFEEHGD

SEQ ID NO: 5538 - protein, 25 aa, synthetic construct
  REGION 1..25: note = Synthetic
TGYALYTAFGQPSQQLRDPFEEHGD

SEQ ID NO: 5539 - protein, 25 aa, synthetic construct
  REGION 1..25: note = Synthetic
TGYALYTAFGQPSQQLRDPFEEHGD

SEQ ID NO: 5540 - protein, 25 aa, synthetic construct
  REGION 1..25: note = Synthetic
TGYALYTAFGQPSQQLRDPFEEHGD

SEQ ID NO: 5541 - protein, 25 aa, synthetic construct
  REGION 1..25: note = Synthetic
TGYALYTAFGQPSQQLRDPFEEHGD

SEQ ID NO: 5542 - protein, 25 aa, synthetic construct
  REGION 1..25: note = Synthetic
TGYALYTAFGQPSQQLRDPFEEHGD

SEQ ID NO: 5543 - protein, 25 aa, synthetic construct
  REGION 1..25: note = Synthetic
TGYALYTAFGQPSQQLRDPFEEHGD

SEQ ID NO: 5544 - protein, 25 aa, synthetic construct
  REGION 1..25: note = Synthetic
TGYALYTAFGQPSQQLRDPFEEHGD

SEQ ID NO: 5545 - protein, 25 aa, synthetic construct
  REGION 1..25: note = Synthetic
TGYALYTAFGQPSQQLRDPFEEHGD

SEQ ID NO: 5546 - protein, 25 aa, synthetic construct
  REGION 1..25: note = Synthetic
TGYALYTAFGQPSQQLRDPFEEHGD

SEQ ID NO: 5547 - protein, 25 aa, synthetic construct
  REGION 1..25: note = Synthetic
TGYALYTAFGQPSQQLRDPFEEHGD

SEQ ID NO: 5548 - protein, 25 aa, synthetic construct
  REGION 1..25: note = Synthetic
TGYALYTAFGQPSQQLRDPFEEHGD

SEQ ID NO: 5549 - protein, 25 aa, synthetic construct
  REGION 1..25: note = Synthetic
TGYALYTAFGQPSQQLRDPFEEHGD

SEQ ID NO: 5550 - protein, 25 aa, synthetic construct
  REGION 1..25: note = Synthetic
TGYALYTAFGQPSQQLRDPFEEHGD

SEQ ID NO: 5551 - protein, 25 aa, synthetic construct
  REGION 1..25: note = Synthetic
TGYALYTAFGQPSQQLRDPFEEHGD

SEQ ID NO: 5552 - protein, 25 aa, synthetic construct
  REGION 1..25: note = Synthetic
TGYALYTAFGQPSQQLRDPFEEHGD

SEQ ID NO: 5553 - protein, 25 aa, synthetic construct
  REGION 1..25: note = Synthetic
TGYALYTAFGQPSQQLRDPFEEHGD

SEQ ID NO: 5554 - protein, 25 aa, synthetic construct
  REGION 1..25: note = Synthetic
TGYALYTAFGQPSQQLRDPFEEHGD

SEQ ID NO: 5555 - protein, 25 aa, synthetic construct
  REGION 1..25: note = Synthetic
TGYALYTAFGQPSQQLRDPFEEHGD

SEQ ID NO: 5556 - protein, 25 aa, synthetic construct
  REGION 1..25: note = Synthetic
TGYALYTAFGQPSQQLRDPFEEHGD

SEQ ID NO: 5557 - protein, 25 aa, synthetic construct
  REGION 1..25: note = Synthetic
TGYALYTAFGQPSQQLRDPFEEHGD

SEQ ID NO: 5558 - protein, 25 aa, synthetic construct
  REGION 1..25: note = Synthetic
TGYALYTAFGQPSQQLRDPFEEHGD

SEQ ID NO: 5559 - protein, 25 aa, synthetic construct
  REGION 1..25: note = Synthetic
TGYALYTAFGQPSQQLRDPFEEHGD

SEQ ID NO: 5560 - protein, 25 aa, synthetic construct
  REGION 1..25: note = Synthetic
TGYALYTAFGQPSQQLRDPFEEHGD

SEQ ID NO: 5561 - protein, 25 aa, synthetic construct
  REGION 1..25: note = Synthetic
TGYALYTAFGQPSQQLRDPFEEHGD

SEQ ID NO: 5562 - protein, 25 aa, synthetic construct
  REGION 1..25: note = Synthetic
TGYALYTAFGQPSQQLRDPFEEHGD

SEQ ID NO: 5563 - protein, 25 aa, synthetic construct
  REGION 1..25: note = Synthetic
TGYALYTAFGQPSQQLRDPFEEHGD

SEQ ID NO: 5564 - protein, 25 aa, synthetic construct
  REGION 1..25: note = Synthetic
TGYALYTAFGQPSQQLRDPFEEHGD

SEQ ID NO: 5565 - protein, 25 aa, synthetic construct
  REGION 1..25: note = Synthetic
TGYALYTAFGQPSQQLRDPFEEHGD

SEQ ID NO: 5566 - protein, 25 aa, synthetic construct
  REGION 1..25: note = Synthetic
TGYALYTAFGQPSQQLRDPFEEHGD

SEQ ID NO: 5567 - protein, 25 aa, synthetic construct
  REGION 1..25: note = Synthetic
TGYALYTAFGQPSQQLRDPFEEHGD

SEQ ID NO: 5568 - protein, 25 aa, synthetic construct
  REGION 1..25: note = Synthetic
TGYALYTAFGQPSQQLRDPFEEHGD

SEQ ID NO: 5569 - protein, 25 aa, synthetic construct
  REGION 1..25: note = Synthetic
TGYALYTAFGQPSQQLRDPFEEHGD

SEQ ID NO: 5570 - protein, 25 aa, synthetic construct
  REGION 1..25: note = Synthetic
TGYALYTAFGQPSQQLRDPFEEHGD

SEQ ID NO: 5571 - protein, 25 aa, synthetic construct
  REGION 1..25: note = Synthetic
TGYALYTAFGQPSQQLRDPFEEHGD

SEQ ID NO: 5572 - protein, 25 aa, synthetic construct
  REGION 1..25: note = Synthetic
TGYALYTAFGQPSQQLRDPFEEHGD

SEQ ID NO: 5573 - protein, 25 aa, synthetic construct
  REGION 1..25: note = Synthetic
TGYALYTAFGQPSQQLRDPFEEHGD

SEQ ID NO: 5574 - protein, 25 aa, synthetic construct
  REGION 1..25: note = Synthetic
TGYALYTAFGQPSQQLRDPFEEHGD

SEQ ID NO: 5575 - protein, 25 aa, synthetic construct
  REGION 1..25: note = Synthetic
TGYALYTAFGQPSQQLRDPFEEHGD

SEQ ID NO: 5576 - protein, 25 aa, synthetic construct
  REGION 1..25: note = Synthetic
TGYALYTAFGQPSQQLRDPFEEHGD

SEQ ID NO: 5577 - protein, 25 aa, synthetic construct
  REGION 1..25: note = Synthetic
TGYALYTAFGQPSQQLRDPFEEHGD

SEQ ID NO: 5578 - protein, 25 aa, synthetic construct
  REGION 1..25: note = Synthetic
TGYALYTAFGQPSQQLRDPFEEHGD

SEQ ID NO: 5579 - protein, 25 aa, synthetic construct
  REGION 1..25: note = Synthetic
TGYALYTAFGQPSQQLRDPFEEHGD

SEQ ID NO: 5580 - protein, 25 aa, synthetic construct
  REGION 1..25: note = Synthetic
TGYALYTAFGQPSQQLRDPFEEHGD

SEQ ID NO: 5581 - protein, 25 aa, synthetic construct
  REGION 1..25: note = Synthetic
TGYALYTAFGQPSQQLRDPFEEHGD

SEQ ID NO: 5582 - protein, 25 aa, synthetic construct
  REGION 1..25: note = Synthetic
TGYALYTAFGQPSQQLRDPFEEHGD

SEQ ID NO: 5583 - protein, 25 aa, synthetic construct
  REGION 1..25: note = Synthetic
TGYALYTAFGQPSQQLRDPFEEHGD

SEQ ID NO: 5584 - protein, 25 aa, synthetic construct
  REGION 1..25: note = Synthetic
TGYALYTAFGQPSQQLRDPFEEHGD

SEQ ID NO: 5585 - protein, 25 aa, synthetic construct
  REGION 1..25: note = Synthetic
TGYALYTAFGQPSQQLRDPFEEHGD

SEQ ID NO: 5586 - protein, 25 aa, synthetic construct
  REGION 1..25: note = Synthetic
TGYALYTAFGQPSQQLRDPFEEHGD

SEQ ID NO: 5587 - protein, 25 aa, synthetic construct
  REGION 1..25: note = Synthetic
TGYALYTAFGQPSQQLRDPFEEHGD

SEQ ID NO: 5588 - protein, 25 aa, synthetic construct
  REGION 1..25: note = Synthetic
TGYALYTAFGQPSQQLRDPFEEHGD

SEQ ID NO: 5589 - protein, 25 aa, synthetic construct
  REGION 1..25: note = Synthetic
TGYALYTAFGQPSQQLRDPFEEHGD

SEQ ID NO: 5590 - protein, 25 aa, synthetic construct
  REGION 1..25: note = Synthetic
TGYALYTAFGQPSQQLRDPFEEHGD

SEQ ID NO: 5591 - protein, 25 aa, synthetic construct
  REGION 1..25: note = Synthetic
TGYALYTAFGQPSQQLRDPFEEHGD

SEQ ID NO: 5592 - protein, 25 aa, synthetic construct
  REGION 1..25: note = Synthetic
TGYALYTAFGQPSQQLRDPFEEHGD

SEQ ID NO: 5593 - protein, 25 aa, synthetic construct
  REGION 1..25: note = Synthetic
TGYALYTAFGQPSQQLRDPFEEHGD

SEQ ID NO: 5594 - protein, 25 aa, synthetic construct
  REGION 1..25: note = Synthetic
TGYALYTAFGQPSQQLRDPFEEHGD

SEQ ID NO: 5595 - protein, 25 aa, synthetic construct
  REGION 1..25: note = Synthetic
TGYALYTAFGQPSQQLRDPFEEHGD

SEQ ID NO: 5596 - protein, 25 aa, synthetic construct
  REGION 1..25: note = Synthetic
TGYALYTAFGQPSQQLRDPFEEHGD

SEQ ID NO: 5597 - protein, 25 aa, synthetic construct
  REGION 1..25: note = Synthetic
TGYALYTAFGQPSQQLRDPFEEHGD

SEQ ID NO: 5598 - protein, 25 aa, synthetic construct
  REGION 1..25: note = Synthetic
TGYALYTAFGQPSQQLRDPFEEHGD

SEQ ID NO: 5599 - protein, 25 aa, synthetic construct
  REGION 1..25: note = Synthetic
TGYALYTAFGQPSQQLRDPFEEHGD

SEQ ID NO: 5600 - protein, 25 aa, synthetic construct
  REGION 1..25: note = Synthetic
TGYALYTAFGQPSQQLRDPFEEHGD

SEQ ID NO: 5601 - protein, 25 aa, synthetic construct
  REGION 1..25: note = Synthetic
TGYALYTAFGQPSQQLRDPFEEHGD

SEQ ID NO: 5602 - protein, 25 aa, synthetic construct
  REGION 1..25: note = Synthetic
TGYALYTAFGQPSQQLRDPFEEHGD

SEQ ID NO: 5603 - protein, 25 aa, synthetic construct
  REGION 1..25: note = Synthetic
TGYALYTAFGQPSQQLRDPFEEHGD

SEQ ID NO: 5604 - protein, 25 aa, synthetic construct
  REGION 1..25: note = Synthetic
TGYALYTAFGQPSQQLRDPFEEHGD

SEQ ID NO: 5605 - protein, 25 aa, synthetic construct
  REGION 1..25: note = Synthetic
TGYALYTAFGQPSQQLRDPFEEHGD

SEQ ID NO: 5606 - protein, 25 aa, synthetic construct
  REGION 1..25: note = Synthetic
TGYALYTAFGQPSQQLRDPFEEHGD

SEQ ID NO: 5607 - protein, 34 aa, synthetic construct
  REGION 1..34: note = Synthetic
AIQCVESACESLCTEGEDRTGCYMYIYSNCPPYV

SEQ ID NO: 5608 - protein, 39 aa, synthetic construct
  REGION 1..39: note = Synthetic
CNSLGRNFTGGECSDARFPGLSVCYCCHNVESSAEMESM

SEQ ID NO: 5609 - protein, 24 aa, synthetic construct
  REGION 1..24: note = Synthetic
DEMNTVLDSLATRDFINWLLQTKI

SEQ ID NO: 5610 - protein, 28 aa, synthetic construct
  REGION 1..28: note = Synthetic
DEMSTILDNLATRDFINWLIQTKITDKK

SEQ ID NO: 5611 - protein, 24 aa, synthetic construct
  REGION 1..24: note = Synthetic
IYGGCYGNANNFKAIEECKRTCAA

SEQ ID NO: 5612 - protein, 42 aa, synthetic construct
  REGION 1..42: note = Synthetic
CLKSAASSFTGLDLGKAASLPSTCSVNIPYKISPSTDCSKVQ

SEQ ID NO: 5613 - protein, 17 aa, synthetic construct
  REGION 1..17: note = Synthetic
GGYCKSMSHGGQCHCYC

SEQ ID NO: 5614 - protein, 26 aa, synthetic construct
  REGION 1..26: note = Synthetic
AALENFGQRMNLIIPGNCSNLVCPSN

SEQ ID NO: 5615 - protein, 20 aa, synthetic construct
  REGION 1..20: note = Synthetic
ERLAYEATSIVNDVNLDHAY

SEQ ID NO: 5616 - protein, 24 aa, synthetic construct
  REGION 1..24: note = Synthetic
TKGADKCDTAYQLFECYYKNRAHI

SEQ ID NO: 5617 - protein, 30 aa, synthetic construct
  REGION 1..30: note = Synthetic
YCTGAGAAAAMVLCTWMACFAGKKQKHYPY

SEQ ID NO: 5618 - protein, 36 aa, synthetic construct
  REGION 1..36: note = Synthetic
GTGMFRMARGYAIARTNWFDPKTGDAIVGYNVTIMH

SEQ ID NO: 5619 - protein, 25 aa, synthetic construct
  REGION 1..25: note = Synthetic
TCLTKMVECIQLPLDVEDSSDTLCC

SEQ ID NO: 5620 - protein, 23 aa, synthetic construct
  REGION 1..23: note = Synthetic
AAKGAGTASKLTFGTGTRLQVTL

SEQ ID NO: 5621 - protein, 39 aa, synthetic construct
  REGION 1..39: note = Synthetic
GIGHFCGKFFNNAVCAEGLKCAKLGEGADGEALEICLRA

SEQ ID NO: 5622 - protein, 25 aa, synthetic construct
  REGION 1..25: note = Synthetic
TGYSLYTSFGNASSELRDPFEEHED

SEQ ID NO: 5623 - protein, 22 aa, synthetic construct
  REGION 1..22: note = Synthetic
TLAGSFVTAYPQYRRGDQLDLR

SEQ ID NO: 5624 - protein, 14 aa, synthetic construct
  REGION 1..14: note = Synthetic
LITALSALVTWMQF

SEQ ID NO: 5625 - protein, 42 aa, synthetic construct
  REGION 1..42: note = Synthetic
GLSCCHRYGGLAERAGCKSVLNQVTCEYEFYRLDDLSKRCDA

SEQ ID NO: 5626 - protein, 27 aa, synthetic construct
  REGION 1..27: note = Synthetic
VEDLARTFFAHFPLGSTLGFHVPYQED

SEQ ID NO: 5627 - protein, 30 aa, synthetic construct
  REGION 1..30: note = Synthetic
MADIVSAGWAFLMVSFTFSLSLVVWGRSGL

SEQ ID NO: 5628 - protein, 31 aa, synthetic construct
  REGION 1..31: note = Synthetic
EQLENGGTSLSEKTVLLLVTPLLAAAWCLHP

SEQ ID NO: 5629 - protein, 22 aa, synthetic construct
  REGION 1..22: note = Synthetic
AAVTTYAGIFTDQLFSMLKGEQ

SEQ ID NO: 5630 - protein, 21 aa, synthetic construct
  REGION 1..21: note = Synthetic
NVYEYANDFASTCASLSSSPA

SEQ ID NO: 5631 - protein, 29 aa, synthetic construct
  REGION 1..29: note = Synthetic
EISTYVGAAVKGSVAGMGAIMGAAAFALL

SEQ ID NO: 5632 - protein, 29 aa, synthetic construct
  REGION 1..29: note = Synthetic
EISTYVGAAVKGSVAGMGAIMGAAAFALL

SEQ ID NO: 5633 - protein, 29 aa, synthetic construct
  REGION 1..29: note = Synthetic
EISTYVGAAVKGSVAGMGAIMGAAAFALL

SEQ ID NO: 5634 - protein, 29 aa, synthetic construct
  REGION 1..29: note = Synthetic
EISTYVGAAVKGSVAGMGAIMGAAAFALL

SEQ ID NO: 5635 - protein, 29 aa, synthetic construct
  REGION 1..29: note = Synthetic
EISTYVGAAVKGSVAGMGAIMGAAAFALL

SEQ ID NO: 5636 - protein, 22 aa, synthetic construct
  REGION 1..22: note = Synthetic
AAMSTYAGILTDQVLSMLKGEE

SEQ ID NO: 5637 - protein, 25 aa, synthetic construct
  REGION 1..25: note = Synthetic
TGYSLYTAFGEPSAELRDPFEEHED

SEQ ID NO: 5638 - protein, 24 aa, synthetic construct
  REGION 1..24: note = Synthetic
SCLSVADEIASSLRNGDIGPFHVG

SEQ ID NO: 5639 - protein, 22 aa, synthetic construct
  REGION 1..22: note = Synthetic
TKADQLAQQAHSNRKLLDIAGK

SEQ ID NO: 5640 - protein, 24 aa, synthetic construct
  REGION 1..24: note = Synthetic
AAHCIARGNRGGYCNSKKVCVCRN

SEQ ID NO: 5641 - protein, 18 aa, synthetic construct
  REGION 1..18: note = Synthetic
KNVAGALVGVVAIAAAMM

SEQ ID NO: 5642 - protein, 24 aa, synthetic construct
  REGION 1..24: note = Synthetic
IYGGCYGNANNFKTIEECKLTCAA

SEQ ID NO: 5643 - protein, 13 aa, synthetic construct
  REGION 1..13: note = Synthetic
GHGGYGHGGRGGY

SEQ ID NO: 5644 - protein, 31 aa, synthetic construct
  REGION 1..31: note = Synthetic
RSCGNLGESCSAHRCCPGLMCMGEASICIPY

SEQ ID NO: 5645 - protein, 37 aa, synthetic construct
  REGION 1..37: note = Synthetic
GTAVIAAVVAALLWKFSRRRSGAPREGGENENGGEEK

SEQ ID NO: 5646 - protein, 23 aa, synthetic construct
  REGION 1..23: note = Synthetic
NTAVSWLRTIFHDCMVESCDASI

SEQ ID NO: 5647 - protein, 41 aa, synthetic construct
  REGION 1..41: note = Synthetic
MKDFTTYLSTAPVVAFAWITITAGLLIEINRFFPDPLVFSF

SEQ ID NO: 5648 - protein, 17 aa, synthetic construct
  REGION 1..17: note = Synthetic
EKCCKNGCGFMTCSRPR

SEQ ID NO: 5649 - protein, 31 aa, synthetic construct
  REGION 1..31: note = Synthetic
VSDGVSAGVGVGVAMIIQTSPSACKKYYKLY

SEQ ID NO: 5650 - protein, 37 aa, synthetic construct
  REGION 1..37: note = Synthetic
GSSAEALLSDLHAFSGSAAWDDSAGGAGGQGLRVTAL

SEQ ID NO: 5651 - protein, 37 aa, synthetic construct
  REGION 1..37: note = Synthetic
NLQGVCAEGFACITLSGNPVMNLNGGGQEVGRCRKKY

SEQ ID NO: 5652 - protein, 39 aa, synthetic construct
  REGION 1..39: note = Synthetic
VSKATDCIEAGNYCGPTVMKICCGFCSPFSKICMNYPQN

SEQ ID NO: 5653 - protein, 23 aa, synthetic construct
  REGION 1..23: note = Synthetic
YGGCGGNANNFKSRGECKRTCAE

SEQ ID NO: 5654 - protein, 21 aa, synthetic construct
  REGION 1..21: note = Synthetic
DVYTYANGFASTCASLSSSSA

SEQ ID NO: 5655 - protein, 41 aa, synthetic construct
  REGION 1..41: note = Synthetic
ISELSNGAETVSSSFLEEVTETSESTVEFPLAETTTFSSTS

SEQ ID NO: 5656 - protein, 28 aa, synthetic construct
  REGION 1..28: note = Synthetic
DEMNTILDNLATRDFINWLIQTKITDKK

SEQ ID NO: 5657 - protein, 22 aa, synthetic construct
  REGION 1..22: note = Synthetic
AAMSTYTGIFTDQVLSVLKGEE

SEQ ID NO: 5658 - protein, 22 aa, synthetic construct
  REGION 1..22: note = Synthetic
AAMSTYTGIFTDQVLSVLKGEE

SEQ ID NO: 5659 - protein, 23 aa, synthetic construct
  REGION 1..23: note = Synthetic
VFQGVSAWFALVFTVGVLNSLVA

SEQ ID NO: 5660 - protein, 32 aa, synthetic construct
  REGION 1..32: note = Synthetic
KAAKAVLDAAPADKFKLMDESFKVAAMEVIVS

SEQ ID NO: 5661 - protein, 26 aa, synthetic construct
  REGION 1..26: note = Synthetic
AMLGFIAALLTESLTGQGTLHFLGIL

SEQ ID NO: 5662 - protein, 14 aa, synthetic construct
  REGION 1..14: note = Synthetic
TWVQEYITELELNA

SEQ ID NO: 5663 - protein, 22 aa, synthetic construct
  REGION 1..22: note = Synthetic
SAAATMIASFSAILIALLFALL

SEQ ID NO: 5664 - protein, 23 aa, synthetic construct
  REGION 1..23: note = Synthetic
NTAVSWLRTIFHDCMVESCDASI

SEQ ID NO: 5665 - protein, 23 aa, synthetic construct
  REGION 1..23: note = Synthetic
NTAVSWLRTIFHDCMVESCDASI

SEQ ID NO: 5666 - protein, 41 aa, synthetic construct
  REGION 1..41: note = Synthetic
MKDFTTYLSTAPVIATIWFTFTAGLLIEINRYFPDPLVFSF

SEQ ID NO: 5667 - protein, 29 aa, synthetic construct
  REGION 1..29: note = Synthetic
NFATSVRYFLNNAATGETVFCNQFRVKVA

SEQ ID NO: 5668 - protein, 22 aa, synthetic construct
  REGION 1..22: note = Synthetic
AAVSTYAGIFTDQVLSMLRGEE

SEQ ID NO: 5669 - protein, 33 aa, synthetic construct
  REGION 1..33: note = Synthetic
DVAAEIMSGLIALAIDSCCSDSDCNANHPDMCS

SEQ ID NO: 5670 - protein, 14 aa, synthetic construct
  REGION 1..14: note = Synthetic
TWVQEYITDLELNA

SEQ ID NO: 5671 - protein, 17 aa, synthetic construct
  REGION 1..17: note = Synthetic
VSGIIAAYTAYYGPIPY

SEQ ID NO: 5672 - protein, 22 aa, synthetic construct
  REGION 1..22: note = Synthetic
AAMSTYTGIFTDQVLSVLKGEE

SEQ ID NO: 5673 - protein, 22 aa, synthetic construct
  REGION 1..22: note = Synthetic
SEAEDFFSKITQKDLLKSVSTA

SEQ ID NO: 5674 - protein, 41 aa, synthetic construct
  REGION 1..41: note = Synthetic
LAGLVQALLALPLAVLVALVALTESIARSSCSIGLSECGLL

SEQ ID NO: 5675 - protein, 22 aa, synthetic construct
  REGION 1..22: note = Synthetic
SEAEDFFSKITQKDLLKSVSTA

SEQ ID NO: 5676 - protein, 23 aa, synthetic construct
  REGION 1..23: note = Synthetic
YGGCGGNANNFKSRGECKRTCAE

SEQ ID NO: 5677 - protein, 25 aa, synthetic construct
  REGION 1..25: note = Synthetic
YSAGRGIVDECCLRPCSVDVLLSYC

SEQ ID NO: 5678 - protein, 37 aa, synthetic construct
  REGION 1..37: note = Synthetic
TFHRLVHTVFTPSNQDTFECEVVHEGVKKTVKWEPDN

SEQ ID NO: 5679 - protein, 40 aa, synthetic construct
  REGION 1..40: note = Synthetic
GGGYGGGYGGRYGGNYGSSSWGSYSSYSSGGYSSYNSGFW

SEQ ID NO: 5680 - protein, 31 aa, synthetic construct
  REGION 1..31: note = Synthetic
GYGKGGGGGGGGGGDGGGGGGGGSAYVGRHE

SEQ ID NO: 5681 - protein, 39 aa, synthetic construct
  REGION 1..39: note = Synthetic
KLVSEAFHQLSIQKEDALKTLEMQVDTLSDLIKSKLLND

SEQ ID NO: 5682 - protein, 30 aa, synthetic construct
  REGION 1..30: note = Synthetic
SYGSEYGNSGYACNFPCSYGRFLLAPRKKF

SEQ ID NO: 5683 - protein, 22 aa, synthetic construct
  REGION 1..22: note = Synthetic
AAMSTYAGILTDQVLSMLKGEE

SEQ ID NO: 5684 - protein, 28 aa, synthetic construct
  REGION 1..28: note = Synthetic
GDSCSKAYHAGMCFMNSNLQLVQHSVKV

SEQ ID NO: 5685 - protein, 42 aa, synthetic construct
  REGION 1..42: note = Synthetic
IDGAWSIWADAGVANPAGNTDCVGIAARVEDVTNPNSCVYTQ

SEQ ID NO: 5686 - protein, 42 aa, synthetic construct; identical to SEQ ID NO: 5685
  REGION 1..42: note = Synthetic

SEQ ID NO: 5687 - protein, 27 aa, synthetic construct
  REGION 1..27: note = Synthetic
GCGGVCAYGESCPSSCNTCYSAQCTAQ

SEQ ID NO: 5688 - protein, 28 aa, synthetic construct
  REGION 1..28: note = Synthetic
RDGCSNAGAFCGIHPGLCCSEICIVWCT

SEQ ID NO: 5689 - protein, 29 aa, synthetic construct
  REGION 1..29: note = Synthetic
ATAISTLSGFCGVVLGFTIDPNTDCNFIQ

SEQ ID NO: 5690 - protein, 31 aa, synthetic construct
  REGION 1..31: note = Synthetic
GHGGCHHYCHGSCCSAAEAKALEAAQVKPQN

SEQ ID NO: 5691 - protein, 40 aa, synthetic construct
  REGION 1..40: note = Synthetic
QNGHDYYGDYYQRHYDEDAAIGPRSREGFRHGASVNYDDY

SEQ ID NO: 5692 - protein, 33 aa, synthetic construct
  REGION 1..33: note = Synthetic
DVAAEMMSGLIALAIDSCCSDSDCNANHPDMCS

SEQ ID NO: 5693 - protein, 28 aa, synthetic construct
  REGION 1..28: note = Synthetic
MSEARNLFTTFGILAILLFFLYLIYAVL

SEQ ID NO: 5694 - protein, 36 aa, synthetic construct
  REGION 1..36: note = Synthetic
GMCSGIGQGCGQDSNCCGDMCCYGQICAMTFAACGP

SEQ ID NO: 5695 - protein, 31 aa, synthetic construct
  REGION 1..31: note = Synthetic
HLLRNMIEMARIESQKEQAELNRKYLDEVGK

SEQ ID NO: 5696 - protein, 35 aa, synthetic construct
  REGION 1..35: note = Synthetic
SDVNKVLDSLAAKEYLLWVMTSKTSGKSNKRQEDH

SEQ ID NO: 5697 - protein, 22 aa, synthetic construct
  REGION 1..22: note = Synthetic
TCISQLAQYADSLLVPETKDAA

SEQ ID NO: 5698 - protein, 21 aa, synthetic construct
  REGION 1..21: note = Synthetic
GYCGSGNAYCGAGNCRCQCRG

SEQ ID NO: 5699 - protein, 22 aa, synthetic construct
  REGION 1..22: note = Synthetic
AAMSTYTGIFTDQVLSVLKGEE

SEQ ID NO: 5700 - protein, 30 aa, synthetic construct
  REGION 1..30: note = Synthetic
NAMPAFGGRLADEDIENVANYVLNKSENGW

SEQ ID NO: 5701 - protein, 14 aa, synthetic construct
  REGION 1..14: note = Synthetic
IIAAYTAYYGPIPY

SEQ ID NO: 5702 - protein, 28 aa, synthetic construct
  REGION 1..28: note = Synthetic
DEMNTILDSLATRDFINWLIQTKITDKK

SEQ ID NO: 5703 - protein, 35 aa, synthetic construct
  REGION 1..35: note = Synthetic
GFAATLVTEAECNLATISGVAECPWILGGGTMPSK

SEQ ID NO: 5704 - protein, 36 aa, synthetic construct
  REGION 1..36: note = Synthetic
SEIGGGCKEGEGEEECLARRTLTAHTDYIYTQQHHN

SEQ ID NO: 5705 - protein, 33 aa, synthetic construct
  REGION 1..33: note = Synthetic
EALEEFKEVARAKGLNPDIVRPQQSETCSPGGN

SEQ ID NO: 5706 - protein, 35 aa, synthetic construct
  REGION 1..35: note = Synthetic
RNAAAKASGLVSLTDRRPECCSHPACNVDHPEICR

SEQ ID NO: 5707 - protein, 19 aa, synthetic construct
  REGION 1..19: note = Synthetic
LGTCYTAGCSCSWPVCTRN

SEQ ID NO: 5708 - protein, 30 aa, synthetic construct
  REGION 1..30: note = Synthetic
FAQEADHVADKLCTEKSGLCQDSAAIHTEL

SEQ ID NO: 5709 - protein, 30 aa, synthetic construct
  REGION 1..30: note = Synthetic
GLPTCGETCFGGTCNTPGCSCSSWPICTRD

SEQ ID NO: 5710 - protein, 27 aa, synthetic construct
  REGION 1..27: note = Synthetic
ASCLEKFNEYAAGLPVRDVYTSDCLPE

SEQ ID NO: 5711 - protein, 28 aa, synthetic construct
  REGION 1..28: note = Synthetic
VKGCAKTCPTAGPGERVKCCYSPRCNKN

SEQ ID NO: 5712 - protein, 31 aa, synthetic construct
  REGION 1..31: note = Synthetic
GLPTCGETCFGGTCNTPGCTCDSSWPICTHN

SEQ ID NO: 5713 - protein, 30 aa, synthetic construct
  REGION 1..30: note = Synthetic
GLPTCGETCFGGTCNTPGCTCDPWPVCTHN

SEQ ID NO: 5714 - protein, 41 aa, synthetic construct
  REGION 1..41: note = Synthetic
IAKAVACAKHIVSEQGITAWVAWKSHCRDHDVSSYVEGCTL

SEQ ID NO: 5715 - protein, 41 aa, synthetic construct
  REGION 1..41: note = Synthetic
IAKAVACAKHIVSEQGITAWVAWKSHCRDHDVSSYVQGCTL

SEQ ID NO: 5716 - protein, 39 aa, synthetic construct
  REGION 1..39: note = Synthetic
GNNYGKGYGGGSGKGKGGGKGGKGGKGGTYKPSHYGGGY

SEQ ID NO: 5717 - protein, 39 aa, synthetic construct; identical to SEQ ID NO: 5716
  REGION 1..39: note = Synthetic

SEQ ID NO: 5718 - protein, 34 aa, synthetic construct
  REGION 1..34: note = Synthetic
SGYCQWAGRYGNACWCIDLPDKVPIRIPGPCRGR

SEQ ID NO: 5719 - protein, 20 aa, synthetic construct
  REGION 1..20: note = Synthetic
GRGFCNSFGNYNFCQCEYPC

SEQ ID NO: 5720 - protein, 31 aa, synthetic construct
  REGION 1..31: note = Synthetic
RSCGHSGAGCYTRPCCPGLHCSGGHAGGLCV

SEQ ID NO: 5721 - protein, 28 aa, synthetic construct
  REGION 1..28: note = Synthetic
VKGCAKTCPTAQPGESVQCCNTPKCNDY

SEQ ID NO: 5722 - protein, 19 aa, synthetic construct
  REGION 1..19: note = Synthetic
ADAQGIVAAYQAFYGPIPF

SEQ ID NO: 5723 - protein, 41 aa, synthetic construct
  REGION 1..41: note = Synthetic
IAKAVACAKQIVSEQGITAWVAWKSHCRDHDVSSYVEGCTL

SEQ ID NO: 5724 - protein, 32 aa, synthetic construct
  REGION 1..32: note = Synthetic
SAAHIVNHAISAVNHQTSLLSYIAFVATGKLS

SEQ ID NO: 5725 - protein, 41 aa, synthetic construct
  REGION 1..41: note = Synthetic
GRGGSEYYGGFHQHHYDEDAAIGPRNPYTYRHGAGVNYDDY

SEQ ID NO: 5726 - protein, 33 aa, synthetic construct
  REGION 1..33: note = Synthetic
EKCMAKYKGVGTVTYFPFPPETIIIYCECLYDC

SEQ ID NO: 5727 - protein, 26 aa, synthetic construct
  REGION 1..26: note = Synthetic
NAKRYLRTLWNSRDCCDPKEPCCFIG

SEQ ID NO: 5728 - protein, 41 aa, synthetic construct
  REGION 1..41: note = Synthetic
HGVNNLGQDGHGQHGYAHGHSDQHGHGGQHGQHDGYKNRGY

SEQ ID NO: 5729 - protein, 32 aa, synthetic construct
  REGION 1..32: note = Synthetic
KACGSNIAACCQTGDSEGNLLNLEANCLAIPL

SEQ ID NO: 5730 - protein, 14 aa, synthetic construct
  REGION 1..14: note = Synthetic
LFASVVALASGFIF

SEQ ID NO: 5731 - protein, 17 aa, synthetic construct
  REGION 1..17: note = Synthetic
EFFNAIWGPGTLVTVSS

SEQ ID NO: 5732 - protein, 24 aa, synthetic construct
  REGION 1..24: note = Synthetic
AGGKCVHIGQSLDFVCVCFPKYYI

SEQ ID NO: 5733 - protein, 17 aa, synthetic construct
  REGION 1..17: note = Synthetic
AAQNFVAWLKSGQPKQE

SEQ ID NO: 5734 - protein, 28 aa, synthetic construct
  REGION 1..28: note = Synthetic
FARGYAQAKTYKVVGLDAVVEYNVFIWH

SEQ ID NO: 5735 - protein, 20 aa, synthetic construct
  REGION 1..20: note = Synthetic
VDHVVDHAQDLVDDGPLDLD

SEQ ID NO: 5736 - protein, 20 aa, synthetic construct
  REGION 1..20: note = Synthetic
GHGFCNTLGTFSFCQCEYPC

SEQ ID NO: 5737 - protein, 28 aa, synthetic construct
  REGION 1..28: note = Synthetic
DCYGYGNGYGNGYGNGYGYGNGYGYGGY

SEQ ID NO: 5738 - protein, 42 aa, synthetic construct
  REGION 1..42: note = Synthetic
AGVGSRIGTGISTTMNARVAVLITAAILSAPVTAIALLEARR

SEQ ID NO: 5739 - protein, 42 aa, synthetic construct; identical to SEQ ID NO: 5738
  REGION 1..42: note = Synthetic

SEQ ID NO: 5740 - protein, 42 aa, synthetic construct; identical to SEQ ID NO: 5738
  REGION 1..42: note = Synthetic

SEQ ID NO: 5741 - protein, 42 aa, synthetic construct; identical to SEQ ID NO: 5738
  REGION 1..42: note = Synthetic

SEQ ID NO: 5742 - protein, 42 aa, synthetic construct; identical to SEQ ID NO: 5738
  REGION 1..42: note = Synthetic

SEQ ID NO: 5743 - protein, 22 aa, synthetic construct
  REGION 1..22: note = Synthetic
AAMSTYAGILTDQVLSMLKGEE

SEQ ID NO: 5744 - protein, 25 aa, synthetic construct
  REGION 1..25: note = Synthetic
YSAGRGIVDECCLRPCSVDVLLSYC

SEQ ID NO: 5745 - protein, 31 aa, synthetic construct
  REGION 1..31: note = Synthetic
HLLREVLEMARAEQMAQQAHSNRKMMEIFGK

SEQ ID NO: 5746 - protein, 27 aa, synthetic construct
  REGION 1..27: note = Synthetic
AASILQALRTMDNDECELCVNIACTGC

SEQ ID NO: 5747 - protein, 29 aa, synthetic construct
  REGION 1..29: note = Synthetic
HLLRNMIEMARIENEREQAGLNRKYLDEV

SEQ ID NO: 5748 - protein, 16 aa, synthetic construct
  REGION 1..16: note = Synthetic
LIALAGAALAAFGLLA

SEQ ID NO: 5749 - protein, 23 aa, synthetic construct
  REGION 1..23: note = Synthetic
YSAYMAKLNALRPADVPVKNHGK

SEQ ID NO: 5750 - protein, 20 aa, synthetic construct
  REGION 1..20: note = Synthetic
ECNQWCTAGCNPDTGKCDTT

SEQ ID NO: 5751 - protein, 14 aa, synthetic construct
  REGION 1..14: note = Synthetic
LFASVAALASGFLF

SEQ ID NO: 5752 - protein, 30 aa, synthetic construct
  REGION 1..30: note = Synthetic
NAMPAFGGRLVDEDIEDAANYVLSQSEKGW

SEQ ID NO: 5753 - protein, 30 aa, synthetic construct; identical to SEQ ID NO: 5752
  REGION 1..30: note = Synthetic

SEQ ID NO: 5754 - protein, 41 aa, synthetic construct
  REGION 1..41: note = Synthetic
MQDVKTYLSTAPVLATLWFGFLAGLLIEINRFFPDALVLPL

SEQ ID NO: 5755 - protein, 41 aa, synthetic construct
  REGION 1..41: note = Synthetic
MQDVKTYLSTAPVLATLWFGLLAGILIEINRFFPDALVLPY

SEQ ID NO: 5756 - protein, 39 aa, synthetic construct; identical to SEQ ID NO: 5716
  REGION 1..39: note = Synthetic

SEQ ID NO: 5757 - protein, 41 aa, synthetic construct
  REGION 1..41: note = Synthetic
GRGGSEYYGGFHQHHYDEDAPIGPRNPYTFRHGAGVNYDDY

SEQ ID NO: 5758 - protein, 28 aa, synthetic construct
  REGION 1..28: note = Synthetic
VKGCAKTCPSAKPGERVKCCSSPRCNEV

SEQ ID NO: 5759 - protein, 35 aa, synthetic construct
  REGION 1..35: note = Synthetic
AGVERLFRALVGRGCPADCPNTCDSSNKCSPGFPG

SEQ ID NO: 5760 - protein, 26 aa, synthetic construct
  REGION 1..26: note = Synthetic
CENGETCCDGWRCRYTGRAVPFMCVP

SEQ ID NO: 5761 - protein, 33 aa, synthetic construct
  REGION 1..33: note = Synthetic
DDGNAAASDLIALTIKGCCSLPPCALSNPDYCG

SEQ ID NO: 5762 - protein, 32 aa, synthetic construct
  REGION 1..32: note = Synthetic
REGCSSGGTFCGIHPGLCCSEFCFLWCITFID

SEQ ID NO: 5763 - protein, 27 aa, synthetic construct
  REGION 1..27: note = Synthetic
FYSLDSAFTTALSSAIIFLFFLINVIL

SEQ ID NO: 5764 - protein, 27 aa, synthetic construct
  REGION 1..27: note = Synthetic
FYSLDSAFTTALSSAIIFLLFLINVIL

SEQ ID NO: 5765 - protein, 41 aa, synthetic construct
  REGION 1..41: note = Synthetic
ISTFSTVGAEADCPISEAIKCVEKCKEKVEVCEPGVCKCSG

SEQ ID NO: 5766 - protein, 12 aa, synthetic construct
  REGION 1..12: note = Synthetic
AGRGCGCGANYY

SEQ ID NO: 5767 - protein, 34 aa, synthetic construct
  REGION 1..34: note = Synthetic
SAFGVGHAACAAHCIGHGYRGGYCNSKAVCTCRR

SEQ ID NO: 5768 - protein, 41 aa, synthetic construct; identical to SEQ ID NO: 5714
  REGION 1..41: note = Synthetic

SEQ ID NO: 5769 - protein, 28 aa, synthetic construct
  REGION 1..28: note = Synthetic
DEMNTVLDHLATKDFINWLIQTKITDRK

SEQ ID NO: 5770 - protein, 32 aa, synthetic construct
  REGION 1..32: note = Synthetic
RDGCSSGGTFCGIHPGLCCSEFCFLWCITFID

SEQ ID NO: 5771 - protein, 23 aa, synthetic construct
  REGION 1..23: note = Synthetic
AARTAASWAQEALRYGTLHSDEL

SEQ ID NO: 5772 - protein, 36 aa, synthetic construct
  REGION 1..36: note = Synthetic
GTGAFRFGRGYALAKTLVFNITSGDAVVEYNVYIWH

SEQ ID NO: 5773 - protein, 23 aa, synthetic construct
  REGION 1..23: note = Synthetic
NKCSQAANNAATKFDVSKCDEQA

SEQ ID NO: 5774 - protein, 17 aa, synthetic construct
  REGION 1..17: note = Synthetic
AAKDFVSWLKAGRGRRE

SEQ ID NO: 5775 - protein, 42 aa, synthetic construct
  REGION 1..42: note = Synthetic
YHGGQGYAKGGLGCSYGCGLSGYGYACYCPWCYERSWFSGCF

SEQ ID NO: 5776 - protein, 14 aa, synthetic construct
  REGION 1..14: note = Synthetic
IIAAYTAYYGPIPY

SEQ ID NO: 5777 - protein, 35 aa, synthetic construct; identical to SEQ ID NO: 5696
  REGION 1..35: note = Synthetic

SEQ ID NO: 5778 - protein, 28 aa, synthetic construct
  REGION 1..28: note = Synthetic
VSLFEGAGNTAQVGAGALVAAVAAALLL

SEQ ID NO: 5779 - protein, 41 aa, synthetic construct
  REGION 1..41: note = Synthetic
ISTFSTVGAEADCPISEAIKCVEKCNQKVEVCEPGVCKCSG

SEQ ID NO: 5780 - protein, 18 aa, synthetic construct
  REGION 1..18: note = Synthetic
ACLGDYCECLRWEGGISI

SEQ ID NO: 5781 - protein, 22 aa, synthetic construct
  REGION 1..22: note = Synthetic
ARAEQIAQQAHSNRKLMDIIGK

SEQ ID NO: 5782 - protein, 40 aa, synthetic construct
  REGION 1..40: note = Synthetic
TGCTCGSACGSWDVRAETTCHCQCAGMDWTGARCCRLHIQ

SEQ ID NO: 5783 - protein, 12 aa, synthetic construct
  REGION 1..12: note = Synthetic
GGEFLEAGGGVR

SEQ ID NO: 5784 - protein, 17 aa, synthetic construct
  REGION 1..17: note = Synthetic
IPAFFASVATLAFGFLF

SEQ ID NO: 5785 - protein, 31 aa, synthetic construct
  REGION 1..31: note = Synthetic
HLLREVLEMARAEQLVQQAHSNRKMMEIFGK

SEQ ID NO: 5786 - protein, 20 aa, synthetic construct
  REGION 1..20: note = Synthetic
GTGCDSGNQCCSGWCIFVCL

SEQ ID NO: 5787 - protein, 28 aa, synthetic construct
  REGION 1..28: note = Synthetic
TGLSTGATSLSLGLQLLLGLLLLLQYWL

SEQ ID NO: 5788 - protein, 27 aa, synthetic construct
  REGION 1..27: note = Synthetic
LGQQGWSAWSTWHYCSGYLPPIDDCFV

SEQ ID NO: 5789 - protein, 33 aa, synthetic construct
  REGION 1..33: note = Synthetic
VFGICADGFACVPLVGERDSQDPEIVGTCVKIP

SEQ ID NO: 5790 - protein, 38 aa, synthetic construct
  REGION 1..38: note = Synthetic
RNAAAKASGLVSLTDRRPECCSDPRCNSSHPELCGGRR

SEQ ID NO: 5791 - protein, 28 aa, synthetic construct
  REGION 1..28: note = Synthetic
GAHALQPAAAILALLPALGLLLWGPGQL

SEQ ID NO: 5792 - protein, 13 aa, synthetic construct
  REGION 1..13: note = Synthetic
AVAAGLLALGAFM

SEQ ID NO: 5793 - protein, 28 aa, synthetic construct
  REGION 1..28: note = Synthetic
VGNFGSAVCAGRVEVEGGVKHCHCYGTS

SEQ ID NO: 5794 - protein, 38 aa, synthetic construct
  REGION 1..38: note = Synthetic
RNAAAKASGLVGLTDRRPECCSDPRCNSTHPELCGGRR

SEQ ID NO: 5795 - protein, 38 aa, synthetic construct; identical to SEQ ID NO: 5794
  REGION 1..38: note = Synthetic

SEQ ID NO: 5796 - protein, 20 aa, synthetic construct
  REGION 1..20: note = Synthetic
AIPEYIARAVAYNLAHSAKV

SEQ ID NO: 5797 - protein, 24 aa, synthetic construct
  REGION 1..24: note = Synthetic
AAHCIARGNRGGYCNSQKVCVCRN

SEQ ID NO: 5798 - protein, 21 aa, synthetic construct
  REGION 1..21: note = Synthetic
LAIMSEAIAKVVLENKHKSSE

SEQ ID NO: 5799 - protein, 31 aa, synthetic construct
  REGION 1..31: note = Synthetic
SAATSLLSGFRTAATFSLATALVFAASFFLL

SEQ ID NO: 5800 - protein, 36 aa, synthetic construct
  REGION 1..36: note = Synthetic
GRNAAAKASDLVSLTDKKRGCCSDPRCNYDHPEICG

SEQ ID NO: 5801 - protein, 23 aa, synthetic construct
  REGION 1..23: note = Synthetic
YIALMAALLASVLAIRLGATLYQ

SEQ ID NO: 5802 - protein, 28 aa, synthetic construct
  REGION 1..28: note = Synthetic
AVKKYLAAVLGKRYKQRIKNKGRRVAYL

SEQ ID NO: 5803 - protein, 24 aa, synthetic construct
  REGION 1..24: note = Synthetic
IYGGCGGNANNFITKEECESTCAA

SEQ ID NO: 5804 - protein, 17 aa, synthetic construct
  REGION 1..17: note = Synthetic
QCADPVSKIVYEAPYEE

SEQ ID NO: 5805 - protein, 33 aa, synthetic construct
  REGION 1..33: note = Synthetic
GLQAIQGCAETCPVPEPDQEVKCCKTDYCNSYF

SEQ ID NO: 5806 - protein, 22 aa, synthetic construct
  REGION 1..22: note = Synthetic
ARAEQLAQQAHSNRKLMEIIGK

SEQ ID NO: 5807 - protein, 22 aa, synthetic construct
  REGION 1..22: note = Synthetic
ARAEQLAQQAHSNRKLMEIIGK

SEQ ID NO: 5808 - protein, 22 aa, synthetic construct
  REGION 1..22: note = Synthetic
ARAEQLAQQAHSNRKLMEIIGK

SEQ ID NO: 5809 - protein, 22 aa, synthetic construct
  REGION 1..22: note = Synthetic
ARAEQLAQQAHSNRKLMEIIGK

SEQ ID NO: 5810 - protein, 22 aa, synthetic construct
  REGION 1..22: note = Synthetic
ARAEQLAQQAHSNRKLMEIIGK

SEQ ID NO: 5811 - protein, 35 aa, synthetic construct
  REGION 1..35: note = Synthetic
GRDAAAKASGLVGLTDRRGCCSHPACNVDHPEICG

SEQ ID NO: 5812 - protein, 41 aa, synthetic construct
  REGION 1..41: note = Synthetic
IAKAVACAKHIVSEQGITAWVAWKSHCRDHDVSSYVEGCSL

SEQ ID NO: 5813 - protein, 41 aa, synthetic construct
  REGION 1..41: note = Synthetic
ISTFSTVGAEGDCPISEAIKCVEKCKEKVEVCEPGVCKCSG

SEQ ID NO: 5814 - protein, 19 aa, synthetic construct
  REGION 1..19: note = Synthetic
MDGYVDSIEDLKMVEPIGN

SEQ ID NO: 5815 - protein, 42 aa, synthetic construct
  REGION 1..42: note = Synthetic
LNSCHSACKSCMCTRSMPGKCRCLDTTDYCYKSCKSSGEDDD

SEQ ID NO: 5816 - protein, 38 aa, synthetic construct
  REGION 1..38: note = Synthetic
MLSIFETVAAAAPVTVAETQQASNNENRGQPGYYCLIA

SEQ ID NO: 5817 - protein, 16 aa, synthetic construct
  REGION 1..16: note = Synthetic
AGAFGAAIAAGVAFLF

SEQ ID NO: 5818 - protein, 24 aa, synthetic construct
  REGION 1..24: note = Synthetic
GNGGGSCFQIVNLKSCLCAFPCQV

SEQ ID NO: 5819 - protein, 33 aa, synthetic construct
  REGION 1..33: note = Synthetic
CGNNGGNCARSGICCNHESCTMDPACEQDSVFS

SEQ ID NO: 5820 - protein, 35 aa, synthetic construct
  REGION 1..35: note = Synthetic
FEPCEAGFENCCSKSCFEFEDVYVCGVSIDYYDSR

SEQ ID NO: 5821 - protein, 31 aa, synthetic construct
  REGION 1..31: note = Synthetic
HLLREVLEMARAEQLAQQAHSNRKMMEIFGK

SEQ ID NO: 5822 - protein, 34 aa, synthetic construct
  REGION 1..34: note = Synthetic
EALEDFEKAAGARGLSTESILIPRQSETCSPGSD

SEQ ID NO: 5823 - protein, 41 aa, synthetic construct
  REGION 1..41: note = Synthetic
GLGVLGGYGGYGYGLGLGAYGYGGYGLGYGLGLGLGHGKIW

SEQ ID NO: 5824 - protein, 22 aa, synthetic construct
  REGION 1..22: note = Synthetic
VALVSALITSFLAVRLGLALYD

SEQ ID NO: 5825 - protein, 30 aa, synthetic construct
  REGION 1..30: note = Synthetic
LAYGSRGAGGVIPPNAVLDFDVELVDIARN

SEQ ID NO: 5826 - protein, 28 aa, synthetic construct
  REGION 1..28: note = Synthetic
AVKKYLAAVLGKRYKQRVKNKGRRIAYL

SEQ ID NO: 5827 - protein, 28 aa, synthetic construct
  REGION 1..28: note = Synthetic
CDYYKGCCSGYVCSPTWKWCVRPGPGRR

SEQ ID NO: 5828 - protein, 28 aa, synthetic construct
  REGION 1..28: note = Synthetic
CDYYKGCCSGYVCSPTWKWCVRPGPGRR

SEQ ID NO: 5829 - protein, 15 aa, synthetic construct
  REGION 1..15: note = Synthetic
LGGACCGTCTDYECH

SEQ ID NO: 5830 - protein, 40 aa, synthetic construct
  REGION 1..40: note = Synthetic
DLIRAALEDADMENDPRSIIDSVKTFCCSTFNLGICCSKK

SEQ ID NO: 5831 - protein, 28 aa, synthetic construct
  REGION 1..28: note = Synthetic
AVKKYLAAVLGKRYKQRVKNKGRRIAYL

SEQ ID NO: 5832 - protein, 27 aa, synthetic construct
  REGION 1..27: note = Synthetic
CDRVAAHCFAASPYNNNNYNIDTTTRC

SEQ ID NO: 5833 - protein, 28 aa, synthetic construct
  REGION 1..28: note = Synthetic
VKGCAETCPTAGPNERVKCCRSPRCNDD

SEQ ID NO: 5834 - protein, 40 aa, synthetic construct
  REGION 1..40: note = Synthetic
GGSGGSGGNDGNDGNDGSSSRGVKLYAYDYYKDDKKGSND

SEQ ID NO: 5835 - protein, 28 aa, synthetic construct
  REGION 1..28: note = Synthetic
AVKKYLAAVLGKRYKQRVKNKGRRIPYL

SEQ ID NO: 5836 - protein, 13 aa, synthetic construct
  REGION 1..13: note = Synthetic
CTDCAQTAAANYC

SEQ ID NO: 5837 - protein, 22 aa, synthetic construct
  REGION 1..22: note = Synthetic
AAVRIYTGILTDQILSMLTGDP

SEQ ID NO: 5838 - protein, 13 aa, synthetic construct
  REGION 1..13: note = Synthetic
AGALLAGAAALLL

SEQ ID NO: 5839 - protein, 23 aa, synthetic construct
  REGION 1..23: note = Synthetic
GFCGSGDAYCGAGSCQSQCRGCR

SEQ ID NO: 5840 - protein, 18 aa, synthetic construct
  REGION 1..18: note = Synthetic
EVAKMAAELAREDAVNGK

SEQ ID NO: 5841 - protein, 36 aa, synthetic construct
  REGION 1..36: note = Synthetic
LGYGSRGAGSVIPPDADLIFETELVDIQREAVDDEL

SEQ ID NO: 5842 - protein, 32 aa, synthetic construct
  REGION 1..32: note = Synthetic
WGDNGCSLWGSCTVDAECCLGNCGGMYCSLLR

SEQ ID NO: 5843 - protein, 24 aa, synthetic construct
  REGION 1..24: note = Synthetic
ARGCGTSCPGGNHPVCCSTDLCNK

SEQ ID NO: 5844 - protein, 24 aa, synthetic construct
  REGION 1..24: note = Synthetic
ARGCGTSCPGGNHPVCCSTDLCNK

SEQ ID NO: 5845 - protein, 18 aa, synthetic construct
  REGION 1..18: note = Synthetic
CGVGTGAADKAIPRDKGK

SEQ ID NO: 5846 - protein, 33 aa, synthetic construct
  REGION 1..33: note = Synthetic
RNCGEQGEGCATRPCCAGLSCVGSRPGGLCQYD

SEQ ID NO: 5847 - protein, 24 aa, synthetic construct
  REGION 1..24: note = Synthetic
YGGYGGNGNRFPTEKACMKRCVKA

SEQ ID NO: 5848 - protein, 13 aa, synthetic construct
  REGION 1..13: note = Synthetic
AGALLAGAAALLL

SEQ ID NO: 5849 - protein, 30 aa, synthetic construct
  REGION 1..30: note = Synthetic
GYGKGGGGGGGGGGGGGGGGGGSGYVGKHE

SEQ ID NO: 5850 - protein, 21 aa, synthetic construct
  REGION 1..21: note = Synthetic
IKTAEKAAKEADQIVMIKTTD

SEQ ID NO: 5851 - protein, 28 aa, synthetic construct
  REGION 1..28: note = Synthetic
AVKKYLAAVLGKRYKQRVKNKGRRIAYL

SEQ ID NO: 5852 - protein, 32 aa, synthetic construct
  REGION 1..32: note = Synthetic
AALTAASGYLSWNDKNCGLLHYFICQTQSRGG

SEQ ID NO: 5853 - protein, 23 aa, synthetic construct
  REGION 1..23: note = Synthetic
AFLGALLSKIFGKRSLRDVDTMK

SEQ ID NO: 5854 - protein, 31 aa, synthetic construct
  REGION 1..31: note = Synthetic
ASCVADGGRSARCCTLSLLGLALVCTDPVGI

SEQ ID NO: 5855 - protein, 14 aa, synthetic construct
  REGION 1..14: note = Synthetic
CVTGAPGCVGGGRL

SEQ ID NO: 5856 - protein, 38 aa, synthetic construct
  REGION 1..38: note = Synthetic
GAVKFGGDVCAAGSVSIAGKCACGCGEYGYGLGAPYLY

SEQ ID NO: 5857 - protein, 30 aa, synthetic construct
  REGION 1..30: note = Synthetic
SYGANCIAYGDTAICECPFGYSGIRCQDPS

SEQ ID NO: 5858 - protein, 11 aa, synthetic construct
  REGION 1..11: note = Synthetic
GGGYYGGYNGY

SEQ ID NO: 5859 - protein, 34 aa, synthetic construct; identical to SEQ ID NO: 5822
  REGION 1..34: note = Synthetic

SEQ ID NO: 5860 - protein, 35 aa, synthetic construct
  REGION 1..35: note = Synthetic
AGVERLFRALVGRGCPADCPNTCDSSNECSPNFPG

SEQ ID NO: 5861 - protein, 40 aa, synthetic construct
  REGION 1..40: note = Synthetic
QSGQKACGSGGRCAVLGLCCSPDGCHADPACDAEATFSQR

SEQ ID NO: 5862 - protein, 38 aa, synthetic construct
  REGION 1..38: note = Synthetic
AGGGGGDAPAAAAEEPKKEEKSEEESDEELGFSLFDDN

SEQ ID NO: 5863 - protein, 17 aa, synthetic construct
  REGION 1..17: note = Synthetic
EGGSGVASPAQADKAEL

SEQ ID NO: 5864 - protein, 41 aa, synthetic construct
  REGION 1..41: note = Synthetic
GERCCKSGCGRFCIPGLQPLQQLKDSNLTDGFNSKLEAQAP

SEQ ID NO: 5865 - protein, 40 aa, synthetic construct
  REGION 1..40: note = Synthetic
GCGCCGGCGGCGCGCGGCGGCGCCGGCGGCGCGCGGCGCC

SEQ ID NO: 5866 - protein, 19 aa, synthetic construct
  REGION 1..19: note = Synthetic
NKAYEFANDAISSVYCEKP

SEQ ID NO: 5867 - protein, 35 aa, synthetic construct
  REGION 1..35: note = Synthetic
AGGSALYTYGDWLVILAGWSLFVSIFIVIEITRGR

SEQ ID NO: 5868 - protein, 29 aa, synthetic construct
  REGION 1..29: note = Synthetic
MNEAKSLFTTFLILAFLLFLLYAFYEAAF

SEQ ID NO: 5869 - protein, 38 aa, synthetic construct; identical to SEQ ID NO: 5856
  REGION 1..38: note = Synthetic

SEQ ID NO: 5870 - protein, 39 aa, synthetic construct
  REGION 1..39: note = Synthetic
GAVKFGGDVCAAGSVSIAGKCACGCGEGYGYGLGSPYLY

SEQ ID NO: 5871 - protein, 28 aa, synthetic construct
  REGION 1..28: note = Synthetic
AVKKYLAAVLGKRYKQRVKNKGRRIAYL

SEQ ID NO: 5872 - protein, 28 aa, synthetic construct
  REGION 1..28: note = Synthetic
ELAQALASNCGASLPVDASPTVDCTTVG

SEQ ID NO: 5873 - protein, 40 aa, synthetic construct
  REGION 1..40: note = Synthetic
GAVKFGGDVCAAGSVSIAGKCACGCGDYGYGYGLGAPYLY

SEQ ID NO: 5874 - protein, 28 aa, synthetic construct
  REGION 1..28: note = Synthetic
AVKKYLAAVLGKRYKQRVKNKGRRIPYL

SEQ ID NO: 5875 - protein, 34 aa, synthetic construct
  REGION 1..34: note = Synthetic
GRYSSMASGFRSSEHKNAYENVLEEEGRVRSTPM

SEQ ID NO: 5876 - protein, 34 aa, synthetic construct
  REGION 1..34: note = Synthetic
GRYSSMASGFRSSEHKNAFENVLEEEGRVRSTPM

SEQ ID NO: 5877 - protein, 17 aa, synthetic construct
  REGION 1..17: note = Synthetic
TAGQEGFKPVGAHIPVA

SEQ ID NO: 5878 - protein, 39 aa, synthetic construct
  REGION 1..39: note = Synthetic
GAVKFGGDVCAAGSVSIAGKCDCGCGEVYGYGLGAPYLY

SEQ ID NO: 5879 - protein, 39 aa, synthetic construct; identical to SEQ ID NO: 5878
  REGION 1..39: note = Synthetic

SEQ ID NO: 5880 - protein, 17 aa, synthetic construct
  REGION 1..17: note = Synthetic
CNTGNQCCSGWCIFLCL

SEQ ID NO: 5881 - protein, 32 aa, synthetic construct
  REGION 1..32: note = Synthetic
RDGCSSGGTFCGIRPGLCCSEFCFLWCITFID

SEQ ID NO: 5882 - protein, 29 aa, synthetic construct
  REGION 1..29: note = Synthetic
AAPGHALLSSVTLGLATSLSLLTVMALCL

SEQ ID NO: 5883 - protein, 16 aa, synthetic construct
  REGION 1..16: note = Synthetic
NNGGEFARGFNEEEIF

SEQ ID NO: 5884 - protein, 36 aa, synthetic construct
  REGION 1..36: note = Synthetic
LAYGKQGAGRVIPPDSTLIFTTELVSIDNDGDRDEL

SEQ ID NO: 5885 - protein, 41 aa, synthetic construct
  REGION 1..41: note = Synthetic
EACKNAAENGDFSIYVGAQFGRFEIWSKDSGNPAILHTYYK

SEQ ID NO: 5886 - protein, 13 aa, synthetic construct
  REGION 1..13: note = Synthetic
VGGEFLAEGGGVR

SEQ ID NO: 5887 - protein, 13 aa, synthetic construct
  REGION 1..13: note = Synthetic
VGGEFLAEGGGVR

SEQ ID NO: 5888 - protein, 13 aa, synthetic construct
  REGION 1..13: note = Synthetic
VGGEFLAEGGGVR

SEQ ID NO: 5889 - protein, 28 aa, synthetic construct
  REGION 1..28: note = Synthetic
AGAGVEAGAGAETVSSSLMIFSSFFLYN

SEQ ID NO: 5890 - protein, 36 aa, synthetic construct
  REGION 1..36: note = Synthetic
AAAAAKAAADTAAAAAKAAADTAAAAAEAAAATARG

SEQ ID NO: 5891 - protein, 23 aa, synthetic construct
  REGION 1..23: note = Synthetic
GGYGGGYGLGNGGYGGCGCGWGY

SEQ ID NO: 5892 - protein, 36 aa, synthetic construct
  REGION 1..36: note = Synthetic
GRNAAAKASGLVGLTDKRQECCSYPACNLDHPELCG

SEQ ID NO: 5893 - protein, 36 aa, synthetic construct; identical to SEQ ID NO: 5892
  REGION 1..36: note = Synthetic

SEQ ID NO: 5894 - protein, 39 aa, synthetic construct
  REGION 1..39: note = Synthetic
TGCTCGSACGSWDVRAETTCHCQCAGMDWTGARCCRVQP

SEQ ID NO: 5895 - protein, 42 aa, synthetic construct
  REGION 1..42: note = Synthetic
GGLGGGQGGGGGLGGGRGGGGYGGGGGGYGGGKYGGGKYGGK

SEQ ID NO: 5896 - protein, 42 aa, synthetic construct
  REGION 1..42: note = Synthetic
GGLGGGQGGGGGLGGGRGGGGYGGGGGGYGGGKYGGGKYGRK

SEQ ID NO: 5897 - protein, 17 aa, synthetic construct
  REGION 1..17: note = Synthetic
CDSGIQCCSGWCIFVCL

SEQ ID NO: 5898 - protein, 42 aa, synthetic construct
  REGION 1..42: note = Synthetic
IDSAYSIWASAGVANPGGNKDCVGIAARVEKTENPIACTYSS

SEQ ID NO: 5899 - protein, 34 aa, synthetic construct
  REGION 1..34: note = Synthetic
GKYSSMAASFRSSEHENAYENIPEEEGKVCSTPM

SEQ ID NO: 5900 - protein, 36 aa, synthetic construct
  REGION 1..36: note = Synthetic
AQGGGATCPGGLCCSQWGWCGSTPKYCGAGCQSNCR

SEQ ID NO: 5901 - protein, 29 aa, synthetic construct
  REGION 1..29: note = Synthetic
DCDAIAAKCFARAPYNDANWDIDTETRCQ

SEQ ID NO: 5902 - protein, 36 aa, synthetic construct
  REGION 1..36: note = Synthetic
AQGGGATCPGGLCCSQWGWCGSTPKYCGAGCQSNCK

SEQ ID NO: 5903 - protein, 17 aa, synthetic construct
  REGION 1..17: note = Synthetic
CDSGIQCCSGWCIFVCF

SEQ ID NO: 5904 - protein, 12 aa, synthetic construct
  REGION 1..12: note = Synthetic
GGEFLAEGGGVR

SEQ ID NO: 5905 - protein, 26 aa, synthetic construct
  REGION 1..26: note = Synthetic
QVLSAVSTVCSCVTTSGCAAAAAATA

SEQ ID NO: 5906 - protein, 16 aa, synthetic construct
  REGION 1..16: note = Synthetic
AVVAAWAAVAAVAAFY

SEQ ID NO: 5907 - protein, 36 aa, synthetic construct
  REGION 1..36: note = Synthetic
TVIGVGGSGCSAQTVCCENTQFNGLINIGCTPINIL

SEQ ID NO: 5908 - protein, 41 aa, synthetic construct
  REGION 1..41: note = Synthetic
VAEMYSYGGGMLVICAWVLLLTLFVVLELTRGLSRGTIRAV

SEQ ID NO: 5909 - protein, 36 aa, synthetic construct
  REGION 1..36: note = Synthetic
FGAGYGGGYGLGYGGYGGGYGLGYGGYGGCGCGCGY

SEQ ID NO: 5910 - protein, 24 aa, synthetic construct
  REGION 1..24: note = Synthetic
QLYSALANKCCHVGCTKRSLARFC

SEQ ID NO: 5911 - protein, 12 aa, synthetic construct
  REGION 1..12: note = Synthetic
VGGGGGGGGGGA

SEQ ID NO: 5912 - protein, 17 aa, synthetic construct
  REGION 1..17: note = Synthetic
CNTGNQCCSGWCIFVCL

SEQ ID NO: 5913 - protein, 17 aa, synthetic construct
  REGION 1..17: note = Synthetic
CNTGNQCCSGWCIFVCL

SEQ ID NO: 5914 - protein, 34 aa, synthetic construct
  REGION 1..34: note = Synthetic
GRYSSVAASFRSSEHENAYENVPEEEGKVRSTPM

SEQ ID NO: 5915 - protein, 33 aa, synthetic construct
  REGION 1..33: note = Synthetic
AAAAAALTAANAKAAAELTAANAAAAAAATARG

SEQ ID NO: 5916 - protein, 41 aa, synthetic construct
  REGION 1..41: note = Synthetic
MKDFTTYLSTAPVLTLVSLTAVAGLLIEINRFFPDALTAAF

SEQ ID NO: 5917 - protein, 28 aa, synthetic construct
  REGION 1..28: note = Synthetic
SSGNKGGAAGLGFIMWLGVSLVMMMFLI

SEQ ID NO: 5918 - protein, 12 aa, synthetic construct
  REGION 1..12: note = Synthetic
GGEFLAEGGGVR

SEQ ID NO: 5919 - protein, 38 aa, synthetic construct
  REGION 1..38: note = Synthetic
DLIRAALEDADTKNDPRLLDYVTGACCAGLNFVCCGKK

SEQ ID NO: 5920 - protein, 20 aa, synthetic construct
  REGION 1..20: note = Synthetic
CKKAGHKGGTCDFFKCKCKV

SEQ ID NO: 5921 - protein, 34 aa, synthetic construct
  REGION 1..34: note = Synthetic
GRYSSMAASFRSSEHENAYENVPEEEGKVRSTPM

SEQ ID NO: 5922 - protein, 14 aa, synthetic construct
  REGION 1..14: note = Synthetic
ADNAAAAAAATARG

SEQ ID NO: 5923 - protein, 11 aa, synthetic construct
  REGION 1..11: note = Synthetic
VGGGGGGGGGA

SEQ ID NO: 5924 - protein, 11 aa, synthetic construct
  REGION 1..11: note = Synthetic
VGGGGGGGGGA

SEQ ID NO: 5925 - protein, 34 aa, synthetic construct
  REGION 1..34: note = Synthetic
CGSGGRCAATGICCSPDGCRTDPACDPESAFSER

SEQ ID NO: 5926 - protein, 20 aa, synthetic construct
  REGION 1..20: note = Synthetic
CKKAGHRGGTCEFFKCKCKV

SEQ ID NO: 5927 - protein, 23 aa, synthetic construct
  REGION 1..23: note = Synthetic
SCVNFGNGFCGDNCGNSWACSGC

SEQ ID NO: 5928 - protein, 22 aa, synthetic construct
  REGION 1..22: note = Synthetic
ITSAGSSVTAYLQYRRGDQLDI

SEQ ID NO: 5929 - protein, 36 aa, synthetic construct
  REGION 1..36: note = Synthetic
NGVSLLSACGGWELIFSGWILFLTIFVVLEVTRGEH

SEQ ID NO: 5930 - protein, 34 aa, synthetic construct
  REGION 1..34: note = Synthetic
CGSGGRCATAGICCSPDGCRTDPACDPESAFSER

SEQ ID NO: 5931 - protein, 34 aa, synthetic construct
  REGION 1..34: note = Synthetic
CGSGGRCAAAGICCSPDGCHADPACDPEAAFSQH

SEQ ID NO: 5932 - protein, 34 aa, synthetic construct
  REGION 1..34: note = Synthetic
CGSGGRCAAAGICCSPDGCHEDPACDPEAAFSQH

SEQ ID NO: 5933 - protein, 39 aa, synthetic construct
  REGION 1..39: note = Synthetic
AAASAGIRPGRYEQAAVIGYDLDASYNGHSRGGYGRGGY

SEQ ID NO: 5934 - protein, 29 aa, synthetic construct
  REGION 1..29: note = Synthetic
ECDAIAAKCFAKAPYNDANWDIDTETRCQ

SEQ ID NO: 5935 - protein, 34 aa, synthetic construct
  REGION 1..34: note = Synthetic
GKYSSMAASFRSNEHENAYENTSEEEGRVHSTPM

SEQ ID NO: 5936 - protein, 29 aa, synthetic construct
  REGION 1..29: note = Synthetic
ECDAIAAKCFAKAPYNDANWDIDTETRCQ

SEQ ID NO: 5937 - protein, 26 aa, synthetic construct
  REGION 1..26: note = Synthetic
QEGKDIATECCGNQCSDDYIRSACCP

SEQ ID NO: 5938 - protein, 28 aa, synthetic construct
  REGION 1..28: note = Synthetic
VATVGGLAAGGLLILFVFGSYSGLGSSL

SEQ ID NO: 5939 - protein, 20 aa, synthetic construct
  REGION 1..20: note = Synthetic
CKKAGHRGGTCDFFKCKCKV

SEQ ID NO: 5940 - protein, 35 aa, synthetic construct
  REGION 1..35: note = Synthetic
AAAAPGAAGGAQLPLGNRERKAGCKNFFWKTFSSC

SEQ ID NO: 5941 - protein, 15 aa, synthetic construct
  REGION 1..15: note = Synthetic
GIVAAYIAYYGPIQF

SEQ ID NO: 5942 - protein, 39 aa, synthetic construct
  REGION 1..39: note = Synthetic
CNTWGGNYSGGECADSSFPGLSICYCCHYVGSSAEMESM

SEQ ID NO: 5943 - protein, 11 aa, synthetic construct
  REGION 1..11: note = Synthetic
VGGGGGGGGGG

SEQ ID NO: 5944 - protein, 11 aa, synthetic construct
  REGION 1..11: note = Synthetic
VGGGGGGGGGG

SEQ ID NO: 5945 - protein, 41 aa, synthetic construct
  REGION 1..41: note = Synthetic
MTNFTTYLSTAPVVALIWFTFTAGLLIEINRFFPDPLVFSF

SEQ ID NO: 5946 - protein, 36 aa, synthetic construct
  REGION 1..36: note = Synthetic
YGGCGGNANNFETRDQCRHTCGASGNVGPRPRIASN

SEQ ID NO: 5947 - protein, 36 aa, synthetic construct
  REGION 1..36: note = Synthetic
ASDGRNAAANAKTPRLIAPFIRDYCCHRGPCMVWCG

SEQ ID NO: 5948 - protein, 36 aa, synthetic construct; identical to SEQ ID NO: 5947
  REGION 1..36: note = Synthetic

SEQ ID NO: 5949 - protein, 19 aa, synthetic construct
  REGION 1..19: note = Synthetic
VSAGVAAVAALVFGSALRI

SEQ ID NO: 5950 - protein, 17 aa, synthetic construct
  REGION 1..17: note = Synthetic
QYAAGVAALAAGALLAL

SEQ ID NO: 5951 - protein, 41 aa, synthetic construct
  REGION 1..41: note = Synthetic
GTAVGKLLTWGGLGIWWFVDLILLITGGLMPSDNSNWCTIY

SEQ ID NO: 5952 - protein, 30 aa, synthetic construct
  REGION 1..30: note = Synthetic
CDWIGTYGDACLCYALPDNVPIKLSGECHR

SEQ ID NO: 5953 - protein, 32 aa, synthetic construct
  REGION 1..32: note = Synthetic
AAAAAALTAAGAAAAAKLTAGGAAAAAAATAA

SEQ ID NO: 5954 - protein, 40 aa, synthetic construct
  REGION 1..40: note = Synthetic
AATAAAAAAATAATAAKAAALTAANAAAAAAATAAAAARG

SEQ ID NO: 5955 - protein, 18 aa, synthetic construct
  REGION 1..18: note = Synthetic
KAAVGMGAGALAAAAMLL

SEQ ID NO: 5956 - protein, 41 aa, synthetic construct
  REGION 1..41: note = Synthetic
GTAVGKLLTLGGLGIWWFVDLILLITGGLMPSDNSNWCTIY

SEQ ID NO: 5957 - protein, 35 aa, synthetic construct
  REGION 1..35: note = Synthetic
GGTGAFRFARGYALPKTYKIVGLDAVVEYNVFIWH

SEQ ID NO: 5958 - protein, 23 aa, synthetic construct
  REGION 1..23: note = Synthetic
SGAANYLTSFSIGTFFVFVLGLI

SEQ ID NO: 5959 - protein, 33 aa, synthetic construct
  REGION 1..33: note = Synthetic
CGSDGITYGNACMLLGASCRSDTPIELVHKGRC

SEQ ID NO: 5960 - protein, 18 aa, synthetic construct
  REGION 1..18: note = Synthetic
SGFASALTFGSGTKVIVL

SEQ ID NO: 5961 - protein, 18 aa, synthetic construct
  REGION 1..18: note = Synthetic
LSGAHEACKTVSCGNPCA

SEQ ID NO: 5962 - protein, 40 aa, synthetic construct
  REGION 1..40: note = Synthetic
ASDGRNAAANVKAPDLIALTVRNDCCHNAPCRNNHPGICG

SEQ ID NO: 5963 - protein, 21 aa, synthetic construct
  REGION 1..21: note = Synthetic
SGAAEGESGVASPAQADKAEL

SEQ ID NO: 5964 - protein, 12 aa, synthetic construct
  REGION 1..12: note = Synthetic
NGGSGGSNGYHY

SEQ ID NO: 5965 - protein, 31 aa, synthetic construct
  REGION 1..31: note = Synthetic
GGGGSPGHGAGGGYPGGHGGGHHGGYQTHGY

SEQ ID NO: 5966 - protein, 39 aa, synthetic construct
  REGION 1..39: note = Synthetic
LTNVQTILNGGPVTEDLRCNRVRLFVNVLDFIVQTPQIG

SEQ ID NO: 5967 - protein, 26 aa, synthetic construct
  REGION 1..26: note = Synthetic
NVGAGGCAKAGLLGILGISICADIHV

SEQ ID NO: 5968 - protein, 14 aa, synthetic construct
  REGION 1..14: note = Synthetic
GTAVAGALYAVVLA

SEQ ID NO: 5969 - protein, 41 aa, synthetic construct
  REGION 1..41: note = Synthetic
VASATSGGGGGGGAPAAESKKEEKKEEKEESDDDMGFSLFE

SEQ ID NO: 5970 - protein, 27 aa, synthetic construct
  REGION 1..27: note = Synthetic
TSGAAAGCGFMAFLEVSVAMLMFLIWL

SEQ ID NO: 5971 - protein, 40 aa, synthetic construct
  REGION 1..40: note = Synthetic
GLGAGGLQPLALEMALQKRGIVDQCCTGTCTRHQLQSYCN

SEQ ID NO: 5972 - protein, 42 aa, synthetic construct
  REGION 1..42: note = Synthetic
ATAATAAAAAAATAVTAAKAAALTAANAAAAAAATAAAAARG

SEQ ID NO: 5973 - protein, 15 aa, synthetic construct
  REGION 1..15: note = Synthetic
AVSVAAAALGGYLFC

SEQ ID NO: 5974 - protein, 30 aa, synthetic construct
  REGION 1..30: note = Synthetic
ADSAKSGAAALGVSAVVVGVTSIAGSFLLL

SEQ ID NO: 5975 - protein, 42 aa, synthetic construct
  REGION 1..42: note = Synthetic
GAGNGGNGGGGNGGNGGGGNGGNNGNGNGNNGLKKYETCYDC

SEQ ID NO: 5976 - protein, 33 aa, synthetic construct
  REGION 1..33: note = Synthetic
ATDGRNAAANARVSPVISKSSKKWCHPNPYTVG

SEQ ID NO: 5977 - protein, 17 aa, synthetic construct
  REGION 1..17: note = Synthetic
LSIAGTVAAAGFFIFSL

SEQ ID NO: 5978 - protein, 41 aa, synthetic construct
  REGION 1..41: note = Synthetic
VASATSGGGGGGGASAAESKKEEKKEEKEESDDDMGFSLFE

SEQ ID NO: 5979 - protein, 40 aa, synthetic construct
  REGION 1..40: note = Synthetic
HGGGYGSGGGGGGGGGQGGGSGSGSGSGYGSGSGGGNGHH

SEQ ID NO: 5980 - protein, 40 aa, synthetic construct; identical to SEQ ID NO: 5979
  REGION 1..40: note = Synthetic

SEQ ID NO: 5981 - protein, 26 aa, synthetic construct
  REGION 1..26: note = Synthetic
EVGTGGCAKVGILGILGISICGGIHL

SEQ ID NO: 5982 - protein, 30 aa, synthetic construct
  REGION 1..30: note = Synthetic
ADSADSGAAALGVSAVVVGVTSIVGSFLFF

SEQ ID NO: 5983 - protein, 38 aa, synthetic construct
  REGION 1..38: note = Synthetic
APAAAGAAAGGAAAPAAEEKKEEEKEESDEDMGFGLFD

SEQ ID NO: 5984 - protein, 23 aa, synthetic construct
  REGION 1..23: note = Synthetic
LHALGTRCCSWDVCDHPSCTCCG

SEQ ID NO: 5985 - protein, 41 aa, synthetic construct
  REGION 1..41: note = Synthetic
GNRVKTGGTAVLINDNGEVNETIVGDNPPKFEESRKESSSN

SEQ ID NO: 5986 - protein, 20 aa, synthetic construct
  REGION 1..20: note = Synthetic
LGTCYTTGCTCNKYRVCTKD

SEQ ID NO: 5987 - protein, 25 aa, synthetic construct
  REGION 1..25: note = Synthetic
SGMSDGTSCGDTGVCQNGLCMGAGS

SEQ ID NO: 5988 - protein, 38 aa, synthetic construct
  REGION 1..38: note = Synthetic
AAAAGGASAAAGGEATEEAAEEEAAEESDDDMSFGLFD

SEQ ID NO: 5989 - protein, 39 aa, synthetic construct
  REGION 1..39: note = Synthetic
GCGSGCKCGDSCSCEKNYNTECDSCSCGSNCSCGDSCSC

SEQ ID NO: 5990 - protein, 29 aa, synthetic construct
  REGION 1..29: note = Synthetic
EQYRGGAGRGKHNQATEENVQDCGEITGW

SEQ ID NO: 5991 - protein, 38 aa, synthetic construct
  REGION 1..38: note = Synthetic
SAAAGAAGAAAGGDAAEEEKEEEAKEESDDDMGFGLFD

SEQ ID NO: 5992 - protein, 42 aa, synthetic construct
  REGION 1..42: note = Synthetic
AGAASAGGAAAAGGAAEAAPEAERAEEEKEESDDDMGFGLFD

SEQ ID NO: 5993 - protein, 27 aa, synthetic construct
  REGION 1..27: note = Synthetic
TWATTIIALLTFGLIYEWTQGGLEWAE

SEQ ID NO: 5994 - protein, 24 aa, synthetic construct
  REGION 1..24: note = Synthetic
CKKAGHNGGTCMFFKCMCVNSKMN

SEQ ID NO: 5995 - protein, 41 aa, synthetic construct
  REGION 1..41: note = Synthetic
GGAAAAGGAAAAGGAAEAAPEEAKEEEKEESDDDMGFGLFD

SEQ ID NO: 5996 - protein, 22 aa, synthetic construct
  REGION 1..22: note = Synthetic
AHSIAHSAAYPAYTAPLTYAAP

SEQ ID NO: 5997 - protein, 39 aa, synthetic construct
  REGION 1..39: note = Synthetic
VAAAAPAAGGAAPAAEAKKEEKVEEKEESDDDMGFSLFD

SEQ ID NO: 5998 - protein, 33 aa, synthetic construct
  REGION 1..33: note = Synthetic
SGGGGAAAPAEKKEAKKEEKEESDDDMGFSLFE

SEQ ID NO: 5999 - protein, 34 aa, synthetic construct
  REGION 1..34: note = Synthetic
SGFGVGDSACAAHCIARRNRGGYCNAKKVCVCRN

SEQ ID NO: 6000 - protein, 13 aa, synthetic construct
  REGION 1..13: note = Synthetic
ASAGAGTGSGYHY

SEQ ID NO: 6001 - protein, 31 aa, synthetic construct
  REGION 1..31: note = Synthetic
AATAATAATAATAATAATAATAATAATAATA

SEQ ID NO: 6002 - protein, 22 aa, synthetic construct
  REGION 1..22: note = Synthetic
SSWKDVVEYLLQVVNMKESAPS

SEQ ID NO: 6003 - protein, 23 aa, synthetic construct
  REGION 1..23: note = Synthetic
STLEDFLERLKTIMKEKYSKCRS

SEQ ID NO: 6004 - protein, 34 aa, synthetic construct
  REGION 1..34: note = Synthetic
KIAEKVAEKVAEAADVVKKVAQDTDGDAQAHDEL

SEQ ID NO: 6005 - protein, 34 aa, synthetic construct
  REGION 1..34: note = Synthetic
SSATTLLDKIDEAIEQSISLCMDSAELLFRCLGC

SEQ ID NO: 6006 - protein, 27 aa, synthetic construct
  REGION 1..27: note = Synthetic
REVDRLASDLQRLAKFQQHSTKHYGFL

SEQ ID NO: 6007 - protein, 35 aa, synthetic construct
  REGION 1..35: note = Synthetic
ISDMKDALEEMKRILNQFQVGNSLLFVFGRRERRC

SEQ ID NO: 6008 - protein, 25 aa, synthetic construct
  REGION 1..25: note = Synthetic
FNSIINRFHDVVNHFTKTTTTTTDV

SEQ ID NO: 6009 - protein, 17 aa, synthetic construct
  REGION 1..17: note = Synthetic
NQCWSQLTECVKNCPCL

SEQ ID NO: 6010 - protein, 26 aa, synthetic construct
  REGION 1..26: note = Synthetic
LANNLKNAAEQVAEPATHEHSGHAEL

SEQ ID NO: 6011 - protein, 23 aa, synthetic construct
  REGION 1..23: note = Synthetic
NNIFNNISRCFSYCSRTCLKRTR

SEQ ID NO: 6012 - protein, 32 aa, synthetic construct
  REGION 1..32: note = Synthetic
EVANSLNRAVHRAVREESGSRRKLLGLHKKFA

SEQ ID NO: 6013 - protein, 30 aa, synthetic construct
  REGION 1..30: note = Synthetic
VDQCKKLLKKIVDTCPGGGYDHTKDGWKSK

SEQ ID NO: 6014 - protein, 14 aa, synthetic construct
  REGION 1..14: note = Synthetic
QHCISTANTMLRKL

SEQ ID NO: 6015 - protein, 35 aa, synthetic construct
  REGION 1..35: note = Synthetic
TLLETLIKNCGDFVHMHVAERDILHEMVKIVKKKV

SEQ ID NO: 6016 - protein, 27 aa, synthetic construct
  REGION 1..27: note = Synthetic
CQHLVTAFKTWFRRASRDPQGPQGGED

SEQ ID NO: 6017 - protein, 15 aa, synthetic construct
  REGION 1..15: note = Synthetic
LSDLLKRVSDLLRSL

SEQ ID NO: 6018 - protein, 27 aa, synthetic construct
  REGION 1..27: note = Synthetic
YALSKLANVLHTAALAGRLREMGADVT

SEQ ID NO: 6019 - protein, 18 aa, synthetic construct
  REGION 1..18: note = Synthetic
VIKCFKEIIEHASQLLAS

SEQ ID NO: 6020 - protein, 14 aa, synthetic construct
  REGION 1..14: note = Synthetic
HIMSDLIQELNTCI

SEQ ID NO: 6021 - protein, 27 aa, synthetic construct
  REGION 1..27: note = Synthetic
EEFLSVVERFLQRAFGTPDEHVFQAAV

SEQ ID NO: 6022 - protein, 34 aa, synthetic construct
  REGION 1..34: note = Synthetic
EGWSSLLRTVHSVLDRSPPLLIAEIILVDDFSDK

SEQ ID NO: 6023 - protein, 25 aa, synthetic construct
  REGION 1..25: note = Synthetic
IETCIENVGELLRTNFGKDVLYEVA

SEQ ID NO: 6024 - protein, 31 aa, synthetic construct
  REGION 1..31: note = Synthetic
REIDDVARELEEMLRAAMIKAAGRERDYDWL

SEQ ID NO: 6025 - protein, 32 aa, synthetic construct
  REGION 1..32: note = Synthetic
VDDILSTMIDKFHEAFLTQDEVMYESAIDNKK

SEQ ID NO: 6026 - protein, 29 aa, synthetic construct
  REGION 1..29: note = Synthetic
ASSCFNNVNDVLRQDVEVVEYLNDLMDTF

SEQ ID NO: 6027 - protein, 30 aa, synthetic construct; identical to SEQ ID NO: 4939
  REGION 1..30: note = Synthetic

SEQ ID NO: 6028 - protein, 32 aa, synthetic construct
  REGION 1..32: note = Synthetic
LVRRLDEFLNQVNHLLVPGTSTKITWIESVCL

SEQ ID NO: 6029 - protein, 15 aa, synthetic construct
  REGION 1..15: note = Synthetic
FFYYLYSMVYTLVSF

SEQ ID NO: 6030 - protein, 12 aa, synthetic construct
  REGION 1..12: note = Synthetic
KMLSRFGRFWKK

SEQ ID NO: 6031 - protein, 12 aa, synthetic construct
  REGION 1..12: note = Synthetic
RAGRKAVKRFLK

SEQ ID NO: 6032 - protein, 11 aa, synthetic construct
  REGION 1..11: note = Synthetic
RVRRLCRGLAR

SEQ ID NO: 6033 - protein, 12 aa, synthetic construct
  REGION 1..12: note = Synthetic
RIVRKVARNLGK

SEQ ID NO: 6034 - protein, 11 aa, synthetic construct
  REGION 1..11: note = Synthetic
RCRRALRRFFA

SEQ ID NO: 6035 - protein, 12 aa, synthetic construct
  REGION 1..12: note = Synthetic
KTFWKKYRTFWK

SEQ ID NO: 6036 - protein, 12 aa, synthetic construct
  REGION 1..12: note = Synthetic
VGKILKKINKAI

SEQ ID NO: 6037 - protein, 12 aa, synthetic construct
  REGION 1..12: note = Synthetic
GRKVCAKLVKRL

SEQ ID NO: 6038 - protein, 12 aa, synthetic construct
  REGION 1..12: note = Synthetic
RLVKHWYQNCKK

SEQ ID NO: 6039 - protein, 12 aa, synthetic construct
  REGION 1..12: note = Synthetic
RGLEKYFRKLSK

SEQ ID NO: 6040 - protein, 12 aa, synthetic construct
  REGION 1..12: note = Synthetic
KRIVQRIKDFLR

SEQ ID NO: 6041 - protein, 12 aa, synthetic construct
  REGION 1..12: note = Synthetic
KRYGGFMRRVGR

SEQ ID NO: 6042 - protein, 11 aa, synthetic construct
  REGION 1..11: note = Synthetic
YKRCARLLTRL

SEQ ID NO: 6043 - protein, 11 aa, synthetic construct
  REGION 1..11: note = Synthetic
YKRCARLLTRL

SEQ ID NO: 6044 - protein, 12 aa, synthetic construct
  REGION 1..12: note = Synthetic
LYKRYGGFLRRI

SEQ ID NO: 6045 - protein, 12 aa, synthetic construct
  REGION 1..12: note = Synthetic
RKLFRVYSNFLR

SEQ ID NO: 6046 - protein, 12 aa, synthetic construct
  REGION 1..12: note = Synthetic
KAIKNLLKAVSK

SEQ ID NO: 6047 - protein, 12 aa, synthetic construct
  REGION 1..12: note = Synthetic
HLLARIWKPYKK

SEQ ID NO: 6048 - protein, 12 aa, synthetic construct
  REGION 1..12: note = Synthetic
HLLARIWKPYKK

SEQ ID NO: 6049 - protein, 11 aa, synthetic construct
  REGION 1..11: note = Synthetic
KVGRKVFSKLR

SEQ ID NO: 6050 - protein, 12 aa, synthetic construct
  REGION 1..12: note = Synthetic
RGIRPVGRFGRR

SEQ ID NO: 6051 - protein, 12 aa, synthetic construct
  REGION 1..12: note = Synthetic
WLRIARRALRFV

SEQ ID NO: 6052 - protein, 12 aa, synthetic construct
  REGION 1..12: note = Synthetic
FMKRYGGFMKKM

SEQ ID NO: 6053 - protein, 12 aa, synthetic construct
  REGION 1..12: note = Synthetic
KCFNKVTGYCRK

SEQ ID NO: 6054 - protein, 12 aa, synthetic construct
  REGION 1..12: note = Synthetic
SICRKARRLAGR

SEQ ID NO: 6055 - protein, 12 aa, synthetic construct
  REGION 1..12: note = Synthetic
SICRKARRLAGR

SEQ ID NO: 6056 - protein, 12 aa, synthetic construct
  REGION 1..12: note = Synthetic
KRYYGRILHYLK

SEQ ID NO: 6057 - protein, 12 aa, synthetic construct
  REGION 1..12: note = Synthetic
KKWVQKYISLLK

SEQ ID NO: 6058 - protein, 11 aa, synthetic construct
  REGION 1..11: note = Synthetic
RWRDVCRNFMR

SEQ ID NO: 6059 - protein, 12 aa, synthetic construct
  REGION 1..12: note = Synthetic
RRYFHRIDNFLK

SEQ ID NO: 6060 - protein, 11 aa, synthetic construct
  REGION 1..11: note = Synthetic
VKLLKRIYDKL

SEQ ID NO: 6061 - protein, 12 aa, synthetic construct
  REGION 1..12: note = Synthetic
KWVQNYMKHLGR

SEQ ID NO: 6062 - protein, 11 aa, synthetic construct
  REGION 1..11: note = Synthetic
LKTIRNGVHKI

SEQ ID NO: 6063 - protein, 11 aa, synthetic construct
  REGION 1..11: note = Synthetic
KFVKVFSRIFG

SEQ ID NO: 6064 - protein, 12 aa, synthetic construct
  REGION 1..12: note = Synthetic
ICNEGKKCCRRW

SEQ ID NO: 6065 - protein, 11 aa, synthetic construct
  REGION 1..11: note = Synthetic
IKRLQRLLQAL

SEQ ID NO: 6066 - protein, 12 aa, synthetic construct
  REGION 1..12: note = Synthetic
RRICSTYRTMYR

SEQ ID NO: 6067 - protein, 11 aa, synthetic construct
  REGION 1..11: note = Synthetic
LRNLFRKLISF

SEQ ID NO: 6068 - protein, 11 aa, synthetic construct
  REGION 1..11: note = Synthetic
EYYRRLLRVLR

SEQ ID NO: 6069 - protein, 12 aa, synthetic construct
  REGION 1..12: note = Synthetic
ARHFWSKICKPV

SEQ ID NO: 6070 - protein, 12 aa, synthetic construct
  REGION 1..12: note = Synthetic
HFWKQVLGGLRK

SEQ ID NO: 6071 - protein, 11 aa, synthetic construct
  REGION 1..11: note = Synthetic
KVHGLLKTFVR

SEQ ID NO: 6072 - protein, 12 aa, synthetic construct
  REGION 1..12: note = Synthetic
IHTLIKAGKKCL

SEQ ID NO: 6073 - protein, 11 aa, synthetic construct
  REGION 1..11: note = Synthetic
KVHGLLKTFVK

SEQ ID NO: 6074 - protein, 12 aa, synthetic construct
  REGION 1..12: note = Synthetic
RFMHSVGRVFSK

SEQ ID NO: 6075 - protein, 11 aa, synthetic construct
  REGION 1..11: note = Synthetic
KFGKNIANMCR

SEQ ID NO: 6076 - protein, 12 aa, synthetic construct
  REGION 1..12: note = Synthetic
ARHFWTKICKPV

SEQ ID NO: 6077 - protein, 12 aa, synthetic construct
  REGION 1..12: note = Synthetic
ARHFWTKICKPV

SEQ ID NO: 6078 - protein, 11 aa, synthetic construct
  REGION 1..11: note = Synthetic
IRAYLKTIRQL

SEQ ID NO: 6079 - protein, 12 aa, synthetic construct
  REGION 1..12: note = Synthetic
KKAVGGLGKLGK

SEQ ID NO: 6080 - protein, 12 aa, synthetic construct
  REGION 1..12: note = Synthetic
RFYSRVLSPLHR

SEQ ID NO: 6081 - protein, 12 aa, synthetic construct
  REGION 1..12: note = Synthetic
CRALIKRIQAMI

SEQ ID NO: 6082 - protein, 12 aa, synthetic construct
  REGION 1..12: note = Synthetic
AYGRCWHVLKKV

SEQ ID NO: 6083 - protein, 11 aa, synthetic construct
  REGION 1..11: note = Synthetic
RFKSLLQKMIH

SEQ ID NO: 6084 - protein, 11 aa, synthetic construct
  REGION 1..11: note = Synthetic
KVVKLIKNYLQ

SEQ ID NO: 6085 - protein, 11 aa, synthetic construct
  REGION 1..11: note = Synthetic
KYMSWINKVIR

SEQ ID NO: 6086 - protein, 12 aa, synthetic construct
  REGION 1..12: note = Synthetic
RECLRRGRALGR

SEQ ID NO: 6087 - protein, 11 aa, synthetic construct
  REGION 1..11: note = Synthetic
GRTAVRRFLKL

SEQ ID NO: 6088 - protein, 12 aa, synthetic construct
  REGION 1..12: note = Synthetic
VQRVVEKFLKRA

SEQ ID NO: 6089 - protein, 11 aa, synthetic construct
  REGION 1..11: note = Synthetic
KGLAKMAKAWA

SEQ ID NO: 6090 - protein, 12 aa, synthetic construct
  REGION 1..12: note = Synthetic
VKKIIEKMLKNG

SEQ ID NO: 6091 - protein, 12 aa, synthetic construct
  REGION 1..12: note = Synthetic
AREVMKACRRAF

SEQ ID NO: 6092 - protein, 12 aa, synthetic construct
  REGION 1..12: note = Synthetic
AREVMKACRRAF

SEQ ID NO: 6093 - protein, 12 aa, synthetic construct
  REGION 1..12: note = Synthetic
AREVMKACRRAF

SEQ ID NO: 6094 - protein, 12 aa, synthetic construct
  REGION 1..12: note = Synthetic
RLVSKALNMWGK

SEQ ID NO: 6095 - protein, 11 aa, synthetic construct
  REGION 1..11: note = Synthetic
KFVKNVIAGIR

SEQ ID NO: 6096 - protein, 11 aa, synthetic construct
  REGION 1..11: note = Synthetic
GKDCSKLGKKC

SEQ ID NO: 6097 - protein, 12 aa, synthetic construct
  REGION 1..12: note = Synthetic
FCKAIVKSGGKI

SEQ ID NO: 6098 - protein, 12 aa, synthetic construct
  REGION 1..12: note = Synthetic
RKLYTIMNSFCR

SEQ ID NO: 6099 - protein, 11 aa, synthetic construct
  REGION 1..11: note = Synthetic
LQKALHHLSRL

SEQ ID NO: 6100 - protein, 12 aa, synthetic construct
  REGION 1..12: note = Synthetic
ARKIPKVGHTFF

SEQ ID NO: 6101 - protein, 12 aa, synthetic construct
  REGION 1..12: note = Synthetic
KILRKISSIANS

SEQ ID NO: 6102 - protein, 12 aa, synthetic construct
  REGION 1..12: note = Synthetic
WRRALRAAAGPL

SEQ ID NO: 6103 - protein, 11 aa, synthetic construct
  REGION 1..11: note = Synthetic
DCKRACAKALK

SEQ ID NO: 6104 - protein, 11 aa, synthetic construct
  REGION 1..11: note = Synthetic
ARPVKNGCRGI

SEQ ID NO: 6105 - protein, 11 aa, synthetic construct
  REGION 1..11: note = Synthetic
CARLRHVARGI

SEQ ID NO: 6106 - protein, 12 aa, synthetic construct
  REGION 1..12: note = Synthetic
LKTAFERLCRHC

SEQ ID NO: 6107 - protein, 12 aa, synthetic construct
  REGION 1..12: note = Synthetic
AQYGKPIKNMCR

SEQ ID NO: 6108 - protein, 11 aa, synthetic construct
  REGION 1..11: note = Synthetic
AALTRALRRLQ

SEQ ID NO: 6109 - protein, 12 aa, synthetic construct
  REGION 1..12: note = Synthetic
FFRVLKKILDSL

SEQ ID NO: 6110 - protein, 12 aa, synthetic construct
  REGION 1..12: note = Synthetic
KVMRWFQAMLQR

SEQ ID NO: 6111 - protein, 12 aa, synthetic construct
  REGION 1..12: note = Synthetic
GHHFVRALVRVC

SEQ ID NO: 6112 - protein, 11 aa, synthetic construct
  REGION 1..11: note = Synthetic
MKCCRNGCGKV

SEQ ID NO: 6113 - protein, 12 aa, synthetic construct
  REGION 1..12: note = Synthetic
FQNCPRGGKRAM

SEQ ID NO: 6114 - protein, 12 aa, synthetic construct
  REGION 1..12: note = Synthetic
CRRIKQAFQGAV

SEQ ID NO: 6115 - protein, 11 aa, synthetic construct
  REGION 1..11: note = Synthetic
IKPCKSVCQRA

SEQ ID NO: 6116 - protein, 11 aa, synthetic construct
  REGION 1..11: note = Synthetic
KFIKNAVAGVR

SEQ ID NO: 6117 - protein, 12 aa, synthetic construct
  REGION 1..12: note = Synthetic
ISSARKLCGRYL

SEQ ID NO: 6118 - protein, 12 aa, synthetic construct
  REGION 1..12: note = Synthetic
CKEFLNRFYKSL

SEQ ID NO: 6119 - protein, 12 aa, synthetic construct
  REGION 1..12: note = Synthetic
KAGLQVYNKCWK

SEQ ID NO: 6120 - protein, 11 aa, synthetic construct
  REGION 1..11: note = Synthetic
RGQRVGSRVGR

SEQ ID NO: 6121 - protein, 11 aa, synthetic construct
  REGION 1..11: note = Synthetic
LRRLHHACQGA

SEQ ID NO: 6122 - protein, 11 aa, synthetic construct
  REGION 1..11: note = Synthetic
CHRCRGLVDKF

SEQ ID NO: 6123 - protein, 11 aa, synthetic construct
  REGION 1..11: note = Synthetic
LARYIQQARKA

SEQ ID NO: 6124 - protein, 11 aa, synthetic construct
  REGION 1..11: note = Synthetic
LARYIQQARKA

SEQ ID NO: 6125 - protein, 11 aa, synthetic construct
  REGION 1..11: note = Synthetic
VNRCKKCGATC

SEQ ID NO: 6126 - protein, 11 aa, synthetic construct
  REGION 1..11: note = Synthetic
HCAKRIVSGAR

SEQ ID NO: 6127 - protein, 12 aa, synthetic construct
  REGION 1..12: note = Synthetic
LKRLLQEIKTCW

SEQ ID NO: 6128 - protein, 11 aa, synthetic construct
  REGION 1..11: note = Synthetic
GISSIIKHYLK

SEQ ID NO: 6129 - protein, 12 aa, synthetic construct
  REGION 1..12: note = Synthetic
RCLSPMNHLCHK

SEQ ID NO: 6130 - protein, 11 aa, synthetic construct
  REGION 1..11: note = Synthetic
LKGLVQKGVKV

SEQ ID NO: 6131 - protein, 12 aa, synthetic construct
  REGION 1..12: note = Synthetic
NGFQLLRHAVKR

SEQ ID NO: 6132 - protein, 12 aa, synthetic construct
  REGION 1..12: note = Synthetic
NGFQLLRHAVKR

SEQ ID NO: 6133 - protein, 12 aa, synthetic construct
  REGION 1..12: note = Synthetic
RTIGATMVRLVK

SEQ ID NO: 6134 - protein, 11 aa, synthetic construct
  REGION 1..11: note = Synthetic
CGRICRDIPKG

SEQ ID NO: 6135 - protein, 12 aa, synthetic construct
  REGION 1..12: note = Synthetic
RHLARTLLTAAR

SEQ ID NO: 6136 - protein, 11 aa, synthetic construct
  REGION 1..11: note = Synthetic
QLLRGWQQMFK

SEQ ID NO: 6137 - protein, 12 aa, synthetic construct
  REGION 1..12: note = Synthetic
RGGLRYMGKLVG

SEQ ID NO: 6138 - protein, 11 aa, synthetic construct
  REGION 1..11: note = Synthetic
MKKYSQILSHF

SEQ ID NO: 6139 - protein, 12 aa, synthetic construct
  REGION 1..12: note = Synthetic
RLIGELAKEIRK

SEQ ID NO: 6140 - protein, 11 aa, synthetic construct
  REGION 1..11: note = Synthetic
LKKVIQKILDG

SEQ ID NO: 6141 - protein, 11 aa, synthetic construct
  REGION 1..11: note = Synthetic
LNLAHNILRKM

SEQ ID NO: 6142 - protein, 12 aa, synthetic construct
  REGION 1..12: note = Synthetic
KELVHTYKGCIR

SEQ ID NO: 6143 - protein, 12 aa, synthetic construct
  REGION 1..12: note = Synthetic
VQRLTRACHQAM

SEQ ID NO: 6144 - protein, 12 aa, synthetic construct
  REGION 1..12: note = Synthetic
HRACSTYRTIYR

SEQ ID NO: 6145 - protein, 12 aa, synthetic construct
  REGION 1..12: note = Synthetic
LRKALDNLARQM

SEQ ID NO: 6146 - protein, 12 aa, synthetic construct
  REGION 1..12: note = Synthetic
LNRYYASLRHYL

SEQ ID NO: 6147 - protein, 11 aa, synthetic construct
  REGION 1..11: note = Synthetic
RAVSNMLQKAR

SEQ ID NO: 6148 - protein, 11 aa, synthetic construct
  REGION 1..11: note = Synthetic
ISRIYGKWYNL

SEQ ID NO: 6149 - protein, 12 aa, synthetic construct
  REGION 1..12: note = Synthetic
FKSFWQKLFAIF

SEQ ID NO: 6150 - protein, 11 aa, synthetic construct
  REGION 1..11: note = Synthetic
RYLDWIKKIIG

SEQ ID NO: 6151 - protein, 12 aa, synthetic construct
  REGION 1..12: note = Synthetic
MKKVHALWASVC

SEQ ID NO: 6152 - protein, 11 aa, synthetic construct
  REGION 1..11: note = Synthetic
AGSAKNIWKRA

SEQ ID NO: 6153 - protein, 11 aa, synthetic construct
  REGION 1..11: note = Synthetic
RVLAQLLRVWG

SEQ ID NO: 6154 - protein, 11 aa, synthetic construct
  REGION 1..11: note = Synthetic
LNYYRNLFRNF

SEQ ID NO: 6155 - protein, 11 aa, synthetic construct
  REGION 1..11: note = Synthetic
VSQLQGLWRRF

SEQ ID NO: 6156 - protein, 11 aa, synthetic construct
  REGION 1..11: note = Synthetic
IQKIFASCWRL

SEQ ID NO: 6157 - protein, 11 aa, synthetic construct
  REGION 1..11: note = Synthetic
QAANKWGRSGR

SEQ ID NO: 6158 - protein, 11 aa, synthetic construct
  REGION 1..11: note = Synthetic
GGNVGRKMKSL

SEQ ID NO: 6159 - protein, 12 aa, synthetic construct
  REGION 1..12: note = Synthetic
YSQYLERLRRFI

SEQ ID NO: 6160 - protein, 12 aa, synthetic construct
  REGION 1..12: note = Synthetic
SALRHYINLITR

SEQ ID NO: 6161 - protein, 11 aa, synthetic construct
  REGION 1..11: note = Synthetic
MKPIQKLLAGL

SEQ ID NO: 6162 - protein, 12 aa, synthetic construct
  REGION 1..12: note = Synthetic
WGRSYCRALERL

SEQ ID NO: 6163 - protein, 12 aa, synthetic construct
  REGION 1..12: note = Synthetic
KIYNVINNLVNK

SEQ ID NO: 6164 - protein, 12 aa, synthetic construct
  REGION 1..12: note = Synthetic
LKKVIQKILDSG

SEQ ID NO: 6165 - protein, 12 aa, synthetic construct
  REGION 1..12: note = Synthetic
RSFRNGVGTGMK

SEQ ID NO: 6166 - protein, 11 aa, synthetic construct
  REGION 1..11: note = Synthetic
RACQQFLKQCQ

SEQ ID NO: 6167 - protein, 12 aa, synthetic construct
  REGION 1..12: note = Synthetic
RAAAAWYRPAGR

SEQ ID NO: 6168 - protein, 12 aa, synthetic construct
  REGION 1..12: note = Synthetic
VQKIIEKILNKG

SEQ ID NO: 6169 - protein, 12 aa, synthetic construct
  REGION 1..12: note = Synthetic
GSRILRFINSFI

SEQ ID NO: 6170 - protein, 11 aa, synthetic construct
  REGION 1..11: note = Synthetic
GGRLSRVLREL

SEQ ID NO: 6171 - protein, 11 aa, synthetic construct
  REGION 1..11: note = Synthetic
QLKKCWNNYVQ

SEQ ID NO: 6172 - protein, 11 aa, synthetic construct
  REGION 1..11: note = Synthetic
SLVKNGVKILH

SEQ ID NO: 6173 - protein, 11 aa, synthetic construct
  REGION 1..11: note = Synthetic
SLVKNGVKILH

SEQ ID NO: 6174 - protein, 11 aa, synthetic construct
  REGION 1..11: note = Synthetic
KFVNSVINTLK

SEQ ID NO: 6175 - protein, 11 aa, synthetic construct
  REGION 1..11: note = Synthetic
SMLGFIGKLFR

SEQ ID NO: 6176 - protein, 12 aa, synthetic construct
  REGION 1..12: note = Synthetic
YPKGFRGYCNGL

SEQ ID NO: 6177 - protein, 12 aa, synthetic construct
  REGION 1..12: note = Synthetic
RLLRRLEDAARQ

SEQ ID NO: 6178 - protein, 12 aa, synthetic construct
  REGION 1..12: note = Synthetic
KMYNVINNLVNK

SEQ ID NO: 6179 - protein, 11 aa, synthetic construct
  REGION 1..11: note = Synthetic
KAKNLIERFFN

SEQ ID NO: 6180 - protein, 11 aa, synthetic construct
  REGION 1..11: note = Synthetic
VKKYLNSILNG

SEQ ID NO: 6181 - protein, 11 aa, synthetic construct
  REGION 1..11: note = Synthetic
EFAQKLLKKFS

SEQ ID NO: 6182 - protein, 11 aa, synthetic construct
  REGION 1..11: note = Synthetic
MNVWGSVWRRA

SEQ ID NO: 6183 - protein, 11 aa, synthetic construct
  REGION 1..11: note = Synthetic
HLARKLLSEVR

SEQ ID NO: 6184 - protein, 11 aa, synthetic construct
  REGION 1..11: note = Synthetic
MSYLKRLCGTF

SEQ ID NO: 6185 - protein, 11 aa, synthetic construct
  REGION 1..11: note = Synthetic
KWVQKYISDLK

SEQ ID NO: 6186 - protein, 11 aa, synthetic construct
  REGION 1..11: note = Synthetic
RLQRLLQGLVG

SEQ ID NO: 6187 - protein, 11 aa, synthetic construct
  REGION 1..11: note = Synthetic
FNRAVKSLQNA

SEQ ID NO: 6188 - protein, 11 aa, synthetic construct
  REGION 1..11: note = Synthetic
VKTCWKTMSSF

SEQ ID NO: 6189 - protein, 11 aa, synthetic construct
  REGION 1..11: note = Synthetic
VKTCWKTMSSF

SEQ ID NO: 6190 - protein, 11 aa, synthetic construct
  REGION 1..11: note = Synthetic
VKTCWKTMSSF

SEQ ID NO: 6191 - protein, 11 aa, synthetic construct
  REGION 1..11: note = Synthetic
VKTCWKTMSSF

SEQ ID NO: 6192 - protein, 12 aa, synthetic construct
  REGION 1..12: note = Synthetic
LMHNLGKHLNSM

SEQ ID NO: 6193 - protein, 12 aa, synthetic construct
  REGION 1..12: note = Synthetic
LHHILSQFRACI

SEQ ID NO: 6194 - protein, 11 aa, synthetic construct
  REGION 1..11: note = Synthetic
VKALKALLGAL

SEQ ID NO: 6195 - protein, 12 aa, synthetic construct
  REGION 1..12: note = Synthetic
KAVEQIKNAFNK

SEQ ID NO: 6196 - protein, 12 aa, synthetic construct
  REGION 1..12: note = Synthetic
KAVEQIKNAFNK

SEQ ID NO: 6197 - protein, 12 aa, synthetic construct
  REGION 1..12: note = Synthetic
KAVEQIKNAFNK

SEQ ID NO: 6198 - protein, 11 aa, synthetic construct
  REGION 1..11: note = Synthetic
GVVNAISRACR

SEQ ID NO: 6199 - protein, 11 aa, synthetic construct
  REGION 1..11: note = Synthetic
GVVNAISRACR

SEQ ID NO: 6200 - protein, 11 aa, synthetic construct
  REGION 1..11: note = Synthetic
GVVNAISRACR

SEQ ID NO: 6201 - protein, 12 aa, synthetic construct
  REGION 1..12: note = Synthetic
LRDAFSRVKTFF

SEQ ID NO: 6202 - protein, 11 aa, synthetic construct
  REGION 1..11: note = Synthetic
LQKVFDRYKSY

SEQ ID NO: 6203 - protein, 11 aa, synthetic construct
  REGION 1..11: note = Synthetic
LQKVFDRYKSY

SEQ ID NO: 6204 - protein, 12 aa, synthetic construct
  REGION 1..12: note = Synthetic
CKGLGAKVHTFV

SEQ ID NO: 6205 - protein, 12 aa, synthetic construct
  REGION 1..12: note = Synthetic
RLGHNLFGIYQK

SEQ ID NO: 6206 - protein, 12 aa, synthetic construct
  REGION 1..12: note = Synthetic
GPRFGKHLLSYC

SEQ ID NO: 6207 - protein, 12 aa, synthetic construct
  REGION 1..12: note = Synthetic
LHHILSQLRACI

SEQ ID NO: 6208 - protein, 11 aa, synthetic construct
  REGION 1..11: note = Synthetic
LASGAHKLVRF

SEQ ID NO: 6209 - protein, 11 aa, synthetic construct
  REGION 1..11: note = Synthetic
LASGAHKLVRF

SEQ ID NO: 6210 - protein, 12 aa, synthetic construct
  REGION 1..12: note = Synthetic
LAQRWMERLKTV

SEQ ID NO: 6211 - protein, 12 aa, synthetic construct
  REGION 1..12: note = Synthetic
VWGHCTKMATRG

SEQ ID NO: 6212 - protein, 11 aa, synthetic construct
  REGION 1..11: note = Synthetic
WKQYKQGFGSI

SEQ ID NO: 6213 - protein, 11 aa, synthetic construct
  REGION 1..11: note = Synthetic
ASSIFKTLRTI

SEQ ID NO: 6214 - protein, 12 aa, synthetic construct
  REGION 1..12: note = Synthetic
WVAVCKQVCTRV

SEQ ID NO: 6215 - protein, 12 aa, synthetic construct
  REGION 1..12: note = Synthetic
GLLQSYLKGLGR

SEQ ID NO: 6216 - protein, 11 aa, synthetic construct
  REGION 1..11: note = Synthetic
MTKMYKGFQAL

SEQ ID NO: 6217 - protein, 12 aa, synthetic construct
  REGION 1..12: note = Synthetic
CARVFHTGGARL

SEQ ID NO: 6218 - protein, 11 aa, synthetic construct
  REGION 1..11: note = Synthetic
IKPCKSVCERA

SEQ ID NO: 6219 - protein, 11 aa, synthetic construct
  REGION 1..11: note = Synthetic
FRSFGSSYSRV

SEQ ID NO: 6220 - protein, 11 aa, synthetic construct
  REGION 1..11: note = Synthetic
LQAIRDGLRKG

SEQ ID NO: 6221 - protein, 12 aa, synthetic construct
  REGION 1..12: note = Synthetic
ATRGCRPWGSLL

SEQ ID NO: 6222 - protein, 12 aa, synthetic construct
  REGION 1..12: note = Synthetic
ATRGCRPWGSLL

SEQ ID NO: 6223 - protein, 12 aa, synthetic construct
  REGION 1..12: note = Synthetic
LGSPIEKLCKHI

SEQ ID NO: 6224 - protein, 12 aa, synthetic construct
  REGION 1..12: note = Synthetic
GPHLFGKIVNRG

SEQ ID NO: 6225 - protein, 11 aa, synthetic construct
  REGION 1..11: note = Synthetic
GVVNAMSRACR

SEQ ID NO: 6226 - protein, 11 aa, synthetic construct
  REGION 1..11: note = Synthetic
GVVNAMSRACR

SEQ ID NO: 6227 - protein, 11 aa, synthetic construct
  REGION 1..11: note = Synthetic
GVVNAMSRACR

SEQ ID NO: 6228 - protein, 12 aa, synthetic construct
  REGION 1..12: note = Synthetic
KWVQDFMKHLDK

SEQ ID NO: 6229 - protein, 12 aa, synthetic construct
  REGION 1..12: note = Synthetic
MREAGAQLKKLV

SEQ ID NO: 6230 - protein, 12 aa, synthetic construct
  REGION 1..12: note = Synthetic
QACNSAMKNINK

SEQ ID NO: 6231 - protein, 12 aa, synthetic construct
  REGION 1..12: note = Synthetic
HHYSKGFRQAAS

SEQ ID NO: 6232 - protein, 12 aa, synthetic construct
  REGION 1..12: note = Synthetic
RAIKPYQTLIKE

SEQ ID NO: 6233 - protein, 12 aa, synthetic construct
  REGION 1..12: note = Synthetic
GEVGRRGKAGLR

SEQ ID NO: 6234 - protein, 11 aa, synthetic construct
  REGION 1..11: note = Synthetic
LTQGLRQLRNA

SEQ ID NO: 6235 - protein, 11 aa, synthetic construct
  REGION 1..11: note = Synthetic
AARVARFVTHV

SEQ ID NO: 6236 - protein, 11 aa, synthetic construct
  REGION 1..11: note = Synthetic
LNQARNGGRHF

SEQ ID NO: 6237 - protein, 11 aa, synthetic construct
  REGION 1..11: note = Synthetic
WKSCTAIGGRC

SEQ ID NO: 6238 - protein, 12 aa, synthetic construct
  REGION 1..12: note = Synthetic
QIFGAVKSLWTK

SEQ ID NO: 6239 - protein, 11 aa, synthetic construct
  REGION 1..11: note = Synthetic
RAVKCGKGLAA

SEQ ID NO: 6240 - protein, 11 aa, synthetic construct
  REGION 1..11: note = Synthetic
TLIKTIVTRIN

SEQ ID NO: 6241 - protein, 11 aa, synthetic construct
  REGION 1..11: note = Synthetic
TLIKTIVTRIN

SEQ ID NO: 6242 - protein, 11 aa, synthetic construct
  REGION 1..11: note = Synthetic
TLIKTIVTRIN

SEQ ID NO: 6243 - protein, 11 aa, synthetic construct
  REGION 1..11: note = Synthetic
TLIKTIVTRIN

SEQ ID NO: 6244 - protein, 11 aa, synthetic construct
  REGION 1..11: note = Synthetic
RARAAGARGCR

SEQ ID NO: 6245 - protein, 11 aa, synthetic construct
  REGION 1..11: note = Synthetic
TAFGSGIHKIR

SEQ ID NO: 6246 - protein, 12 aa, synthetic construct
  REGION 1..12: note = Synthetic
AAGAFRGLKQLI

SEQ ID NO: 6247 - protein, 11 aa, synthetic construct
  REGION 1..11: note = Synthetic
LERLRRGLAAG

SEQ ID NO: 6248 - protein, 11 aa, synthetic construct
  REGION 1..11: note = Synthetic
AYIQSLLKRYQ

SEQ ID NO: 6249 - protein, 11 aa, synthetic construct
  REGION 1..11: note = Synthetic
IASFVKKYNTY

SEQ ID NO: 6250 - protein, 11 aa, synthetic construct
  REGION 1..11: note = Synthetic
IASFVKKYNTY

SEQ ID NO: 6251 - protein, 11 aa, synthetic construct
  REGION 1..11: note = Synthetic
LNMAKNALRNM

SEQ ID NO: 6252 - protein, 11 aa, synthetic construct
  REGION 1..11: note = Synthetic
KVGQACCRPIA

SEQ ID NO: 6253 - protein, 11 aa, synthetic construct
  REGION 1..11: note = Synthetic
FRPAARGLAQC

SEQ ID NO: 6254 - protein, 11 aa, synthetic construct
  REGION 1..11: note = Synthetic
CGRGYNQFKSV

SEQ ID NO: 6255 - protein, 12 aa, synthetic construct
  REGION 1..12: note = Synthetic
SFMQGYMKHATK

SEQ ID NO: 6256 - protein, 11 aa, synthetic construct
  REGION 1..11: note = Synthetic
VSAAFKGLKSL

SEQ ID NO: 6257 - protein, 12 aa, synthetic construct
  REGION 1..12: note = Synthetic
VKKLLEALSHLV

SEQ ID NO: 6258 - protein, 12 aa, synthetic construct
  REGION 1..12: note = Synthetic
KRLARAAEAWAT

SEQ ID NO: 6259 - protein, 12 aa, synthetic construct
  REGION 1..12: note = Synthetic
SWAAGAPRAGRR

SEQ ID NO: 6260 - protein, 12 aa, synthetic construct
  REGION 1..12: note = Synthetic
RAATVLRQFYSH

SEQ ID NO: 6261 - protein, 11 aa, synthetic construct
  REGION 1..11: note = Synthetic
QYSQALKKVFA

SEQ ID NO: 6262 - protein, 12 aa, synthetic construct
  REGION 1..12: note = Synthetic
ASWMSRLRALLG

SEQ ID NO: 6263 - protein, 11 aa, synthetic construct
  REGION 1..11: note = Synthetic
QWAHRAFAPLR

SEQ ID NO: 6264 - protein, 11 aa, synthetic construct
  REGION 1..11: note = Synthetic
GKSFIKDALKC

SEQ ID NO: 6265 - protein, 11 aa, synthetic construct
  REGION 1..11: note = Synthetic
RYHTCGGTLIR

SEQ ID NO: 6266 - protein, 12 aa, synthetic construct
  REGION 1..12: note = Synthetic
VTGVVRQWLSRG

SEQ ID NO: 6267 - protein, 12 aa, synthetic construct
  REGION 1..12: note = Synthetic
YNTYASRLYRTV

SEQ ID NO: 6268 - protein, 12 aa, synthetic construct
  REGION 1..12: note = Synthetic
FCHNILSCCKNM

SEQ ID NO: 6269 - protein, 11 aa, synthetic construct
  REGION 1..11: note = Synthetic
LRTALQHLHGV

SEQ ID NO: 6270 - protein, 11 aa, synthetic construct
  REGION 1..11: note = Synthetic
VNEILNHMKRA

SEQ ID NO: 6271 - protein, 11 aa, synthetic construct
  REGION 1..11: note = Synthetic
RMRRYADAIFT

SEQ ID NO: 6272 - protein, 12 aa, synthetic construct
  REGION 1..12: note = Synthetic
KRIIDSARSAYQ

SEQ ID NO: 6273 - protein, 11 aa, synthetic construct
  REGION 1..11: note = Synthetic
LGRWTHLCGTW

SEQ ID NO: 6274 - protein, 11 aa, synthetic construct
  REGION 1..11: note = Synthetic
RVDKLVEKILH

SEQ ID NO: 6275 - protein, 11 aa, synthetic construct
  REGION 1..11: note = Synthetic
RGMKLLGALLA

SEQ ID NO: 6276 - protein, 11 aa, synthetic construct
  REGION 1..11: note = Synthetic
GVYTKVYNYVK

SEQ ID NO: 6277 - protein, 11 aa, synthetic construct
  REGION 1..11: note = Synthetic
SWLHGLKALGH

SEQ ID NO: 6278 - protein, 11 aa, synthetic construct
  REGION 1..11: note = Synthetic
LQAAFSQYKKV

SEQ ID NO: 6279 - protein, 12 aa, synthetic construct
  REGION 1..12: note = Synthetic
KYFTLGESWLRK

SEQ ID NO: 6280 - protein, 12 aa, synthetic construct
  REGION 1..12: note = Synthetic
SFLEHLQRALRS

SEQ ID NO: 6281 - protein, 12 aa, synthetic construct
  REGION 1..12: note = Synthetic
KNIKEFLQSFVH

SEQ ID NO: 6282 - protein, 12 aa, synthetic construct
  REGION 1..12: note = Synthetic
KALNSIIDVYHK

SEQ ID NO: 6283 - protein, 12 aa, synthetic construct
  REGION 1..12: note = Synthetic
LLARGAKWGQAL

SEQ ID NO: 6284 - protein, 12 aa, synthetic construct
  REGION 1..12: note = Synthetic
GRGFITKAINSC

SEQ ID NO: 6285 - protein, 12 aa, synthetic construct
  REGION 1..12: note = Synthetic
GRGFITKAINSC

SEQ ID NO: 6286 - protein, 12 aa, synthetic construct
  REGION 1..12: note = Synthetic
GRGFITKAINSC

SEQ ID NO: 6287 - protein, 12 aa, synthetic construct
  REGION 1..12: note = Synthetic
GRAVYQSMCKPI

SEQ ID NO: 6288 - protein, 11 aa, synthetic construct
  REGION 1..11: note = Synthetic
KVISGILTQGR

SEQ ID NO: 6289 - protein, 11 aa, synthetic construct
  REGION 1..11: note = Synthetic
HLLRTLLELAR

SEQ ID NO: 6290 - protein, 12 aa, synthetic construct
  REGION 1..12: note = Synthetic
MAQFIHLFSKFY

SEQ ID NO: 6291 - protein, 11 aa, synthetic construct
  REGION 1..11: note = Synthetic
GYNAAYNRYFR

SEQ ID NO: 6292 - protein, 12 aa, synthetic construct
  REGION 1..12: note = Synthetic
RKLGSILNEFGH

SEQ ID NO: 6293 - protein, 12 aa, synthetic construct
  REGION 1..12: note = Synthetic
LGGRVCAAVTRC

SEQ ID NO: 6294 - protein, 12 aa, synthetic construct
  REGION 1..12: note = Synthetic
GMWHRAEHALQR

SEQ ID NO: 6295 - protein, 11 aa, synthetic construct
  REGION 1..11: note = Synthetic
LHHWLHRLQEA

SEQ ID NO: 6296 - protein, 12 aa, synthetic construct
  REGION 1..12: note = Synthetic
ALELARRGARVV

SEQ ID NO: 6297 - protein, 11 aa, synthetic construct
  REGION 1..11: note = Synthetic
RAAHAILGGLH

SEQ ID NO: 6298 - protein, 12 aa, synthetic construct
  REGION 1..12: note = Synthetic
ARAAWGRAGQPW

SEQ ID NO: 6299 - protein, 11 aa, synthetic construct
  REGION 1..11: note = Synthetic
DAVACAKRVVR

SEQ ID NO: 6300 - protein, 12 aa, synthetic construct
  REGION 1..12: note = Synthetic
RLASAGCSGWTR

SEQ ID NO: 6301 - protein, 11 aa, synthetic construct
  REGION 1..11: note = Synthetic
RAANALCAGMR

SEQ ID NO: 6302 - protein, 11 aa, synthetic construct
  REGION 1..11: note = Synthetic
LQLGRTMCGKF

SEQ ID NO: 6303 - protein, 11 aa, synthetic construct
  REGION 1..11: note = Synthetic
FSLGKQVGNKF

SEQ ID NO: 6304 - protein, 12 aa, synthetic construct
  REGION 1..12: note = Synthetic
GRRALSAVPAVL

SEQ ID NO: 6305 - protein, 12 aa, synthetic construct
  REGION 1..12: note = Synthetic
SVFGRVMQIGSR

SEQ ID NO: 6306 - protein, 11 aa, synthetic construct
  REGION 1..11: note = Synthetic
KVAKQVFQVAA

SEQ ID NO: 6307 - protein, 11 aa, synthetic construct
  REGION 1..11: note = Synthetic
LDTALRRARSA

SEQ ID NO: 6308 - protein, 11 aa, synthetic construct
  REGION 1..11: note = Synthetic
AIIKNAYKKGE

SEQ ID NO: 6309 - protein, 12 aa, synthetic construct
  REGION 1..12: note = Synthetic
LHAVVKNCFAVV

SEQ ID NO: 6310 - protein, 11 aa, synthetic construct
  REGION 1..11: note = Synthetic
FRRAYEAARAA

SEQ ID NO: 6311 - protein, 11 aa, synthetic construct
  REGION 1..11: note = Synthetic
KAGSRGLTSLA

SEQ ID NO: 6312 - protein, 11 aa, synthetic construct
  REGION 1..11: note = Synthetic
AACRRAYAAFS

SEQ ID NO: 6313 - protein, 11 aa, synthetic construct
  REGION 1..11: note = Synthetic
QVGQKAANALK

SEQ ID NO: 6314 - protein, 11 aa, synthetic construct
  REGION 1..11: note = Synthetic
VQKLAHQIYQF

SEQ ID NO: 6315 - protein, 11 aa, synthetic construct
  REGION 1..11: note = Synthetic
CDQCRHVVSKY

SEQ ID NO: 6316 - protein, 11 aa, synthetic construct
  REGION 1..11: note = Synthetic
CDQCRHVVSKY

SEQ ID NO: 6317 - protein, 11 aa, synthetic construct
  REGION 1..11: note = Synthetic
KVVGCARTVGN

SEQ ID NO: 6318 - protein, 11 aa, synthetic construct
  REGION 1..11: note = Synthetic
VRVLHSIGHSA

SEQ ID NO: 6319 - protein, 12 aa, synthetic construct
  REGION 1..12: note = Synthetic
GKYGKTGSAGAR

SEQ ID NO: 6320 - protein, 11 aa, synthetic construct
  REGION 1..11: note = Synthetic
RVVHAAKAALA

SEQ ID NO: 6321 - protein, 11 aa, synthetic construct
  REGION 1..11: note = Synthetic
LGVAGNIVRHI

SEQ ID NO: 6322 - protein, 11 aa, synthetic construct
  REGION 1..11: note = Synthetic
SLVSGIGRHVQ

SEQ ID NO: 6323 - protein, 12 aa, synthetic construct
  REGION 1..12: note = Synthetic
RRGVSQAPTAAR

SEQ ID NO: 6324 - protein, 12 aa, synthetic construct
  REGION 1..12: note = Synthetic
RGFPSGMGAAGR

SEQ ID NO: 6325 - protein, 12 aa, synthetic construct
  REGION 1..12: note = Synthetic
RKAIHELIQVMA

SEQ ID NO: 6326 - protein, 12 aa, synthetic construct
  REGION 1..12: note = Synthetic
RKAIHELIQVMA

SEQ ID NO: 6327 - protein, 12 aa, synthetic construct
  REGION 1..12: note = Synthetic
RKAIHELIQVMA

SEQ ID NO: 6328 - protein, 12 aa, synthetic construct
  REGION 1..12: note = Synthetic
RKAIHELIQVMA

SEQ ID NO: 6329 - protein, 12 aa, synthetic construct
  REGION 1..12: note = Synthetic
RKAIHELIQVMA

SEQ ID NO: 6330 - protein, 12 aa, synthetic construct
  REGION 1..12: note = Synthetic
RKAIHELIQVMA

SEQ ID NO: 6331 - protein, 12 aa, synthetic construct
  REGION 1..12: note = Synthetic
RKAIHELIQVMA

SEQ ID NO: 6332 - protein, 12 aa, synthetic construct
  REGION 1..12: note = Synthetic
RKAIHELIQVMA

SEQ ID NO: 6333 - protein, 12 aa, synthetic construct
  REGION 1..12: note = Synthetic
RKAIHELIQVMA

SEQ ID NO: 6334 - protein, 12 aa, synthetic construct
  REGION 1..12: note = Synthetic
RKAIHELIQVMA

SEQ ID NO: 6335 - protein, 12 aa, synthetic construct
  REGION 1..12: note = Synthetic
LRHLYTSGPHGL

SEQ ID NO: 6336 - protein, 12 aa, synthetic construct
  REGION 1..12: note = Synthetic
KAALSMCKSVVA

SEQ ID NO: 6337 - protein, 11 aa, synthetic construct
  REGION 1..11: note = Synthetic
HALAKACSAGR

SEQ ID NO: 6338 - protein, 11 aa, synthetic construct
  REGION 1..11: note = Synthetic
HALAKACSAGR

SEQ ID NO: 6339 - protein, 12 aa, synthetic construct
  REGION 1..12: note = Synthetic
SGVQKYTRALHD

SEQ ID NO: 6340 - protein, 11 aa, synthetic construct
  REGION 1..11: note = Synthetic
GKWYHTCGGSL

SEQ ID NO: 6341 - protein, 11 aa, synthetic construct
  REGION 1..11: note = Synthetic
VELLRRIYDRL

SEQ ID NO: 6342 - protein, 11 aa, synthetic construct
  REGION 1..11: note = Synthetic
VELLKRIYDRL

SEQ ID NO: 6343 - protein, 11 aa, synthetic construct
  REGION 1..11: note = Synthetic
VELLKRIYDKL

SEQ ID NO: 6344 - protein, 11 aa, synthetic construct
  REGION 1..11: note = Synthetic
VELLKRIYDKL

SEQ ID NO: 6345 - protein, 11 aa, synthetic construct
  REGION 1..11: note = Synthetic
VELLKRIYDKL

SEQ ID NO: 6346 - protein, 11 aa, synthetic construct
  REGION 1..11: note = Synthetic
VELLKRIYDKL

SEQ ID NO: 6347 - protein, 11 aa, synthetic construct
  REGION 1..11: note = Synthetic
VELLKRIYDKL

SEQ ID NO: 6348 - protein, 11 aa, synthetic construct
  REGION 1..11: note = Synthetic
DLYQLLQRLFK

SEQ ID NO: 6349 - protein, 12 aa, synthetic construct
  REGION 1..12: note = Synthetic
AACRAMWGLAAR

SEQ ID NO: 6350 - protein, 12 aa, synthetic construct
  REGION 1..12: note = Synthetic
LKEMIETLARKL

SEQ ID NO: 6351 - protein, 11 aa, synthetic construct
  REGION 1..11: note = Synthetic
KGSSGCKACVS

SEQ ID NO: 6352 - protein, 12 aa, synthetic construct
  REGION 1..12: note = Synthetic
EWIQRMMEVLRK

SEQ ID NO: 6353 - protein, 11 aa, synthetic construct
  REGION 1..11: note = Synthetic
CKGVFHAIVSG

SEQ ID NO: 6354 - protein, 12 aa, synthetic construct
  REGION 1..12: note = Synthetic
VVAKVGHLYAAW

SEQ ID NO: 6355 - protein, 12 aa, synthetic construct
  REGION 1..12: note = Synthetic
LNRWITFCQSII

SEQ ID NO: 6356 - protein, 12 aa, synthetic construct
  REGION 1..12: note = Synthetic
AAHCLKEGLKVY

SEQ ID NO: 6357 - protein, 11 aa, synthetic construct
  REGION 1..11: note = Synthetic
EIMQGFIRAFR

SEQ ID NO: 6358 - protein, 12 aa, synthetic construct
  REGION 1..12: note = Synthetic
VASRGRAVCGGV

SEQ ID NO: 6359 - protein, 11 aa, synthetic construct
  REGION 1..11: note = Synthetic
VNKYLGRWYEI

SEQ ID NO: 6360 - protein, 11 aa, synthetic construct
  REGION 1..11: note = Synthetic
GARGGARGTRY

SEQ ID NO: 6361 - protein, 11 aa, synthetic construct
  REGION 1..11: note = Synthetic
IDAFIKSIRTM

SEQ ID NO: 6362 - protein, 11 aa, synthetic construct
  REGION 1..11: note = Synthetic
LSKCAEQFCRL

SEQ ID NO: 6363 - protein, 11 aa, synthetic construct
  REGION 1..11: note = Synthetic
EALQEVLKKLK

SEQ ID NO: 6364 - protein, 11 aa, synthetic construct
  REGION 1..11: note = Synthetic
YNRLVRSLLEC

SEQ ID NO: 6365 - protein, 12 aa, synthetic construct
  REGION 1..12: note = Synthetic
LLGGVNKIAEKI

SEQ ID NO: 6366 - protein, 11 aa, synthetic construct
  REGION 1..11: note = Synthetic
YRSFSNIISTL

SEQ ID NO: 6367 - protein, 12 aa, synthetic construct
  REGION 1..12: note = Synthetic
IVTIINTLLKLV

SEQ ID NO: 6368 - protein, 12 aa, synthetic construct
  REGION 1..12: note = Synthetic
HCIHDGKTYVKG

SEQ ID NO: 6369 - protein, 12 aa, synthetic construct
  REGION 1..12: note = Synthetic
AGWGIVNHAGRR

SEQ ID NO: 6370 - protein, 12 aa, synthetic construct
  REGION 1..12: note = Synthetic
TFLKSLLEIFQK

SEQ ID NO: 6371 - protein, 12 aa, synthetic construct
  REGION 1..12: note = Synthetic
ISHAPNAVKTAF

SEQ ID NO: 6372 - protein, 11 aa, synthetic construct
  REGION 1..11: note = Synthetic
KWVQDYIKDMK

SEQ ID NO: 6373 - protein, 12 aa, synthetic construct
  REGION 1..12: note = Synthetic
WKSAVQGLLNYI

SEQ ID NO: 6374 - protein, 11 aa, synthetic construct
  REGION 1..11: note = Synthetic
VKDVTKLVANL

SEQ ID NO: 6375 - protein, 12 aa, synthetic construct
  REGION 1..12: note = Synthetic
CGSNGKTYLNHC

SEQ ID NO: 6376 - protein, 11 aa, synthetic construct
  REGION 1..11: note = Synthetic
RCLQKWFEPAQ

SEQ ID NO: 6377 - protein, 11 aa, synthetic construct
  REGION 1..11: note = Synthetic
YDTLIKDLKKA

SEQ ID NO: 6378 - protein, 11 aa, synthetic construct
  REGION 1..11: note = Synthetic
GQKACGSGGRC

SEQ ID NO: 6379 - protein, 12 aa, synthetic construct
  REGION 1..12: note = Synthetic
AKSVCRMLSDLC

SEQ ID NO: 6380 - protein, 11 aa, synthetic construct
  REGION 1..11: note = Synthetic
GGTVERLFKNL

SEQ ID NO: 6381 - protein, 12 aa, synthetic construct
  REGION 1..12: note = Synthetic
LTRWMQYLREGY

SEQ ID NO: 6382 - protein, 11 aa, synthetic construct
  REGION 1..11: note = Synthetic
AGAEVVHRYYR

SEQ ID NO: 6383 - protein, 11 aa, synthetic construct
  REGION 1..11: note = Synthetic
DVKTVLQNWLK

SEQ ID NO: 6384 - protein, 11 aa, synthetic construct
  REGION 1..11: note = Synthetic
HLFRHGVAHGQ

SEQ ID NO: 6385 - protein, 12 aa, synthetic construct
  REGION 1..12: note = Synthetic
WRSFFKEALQGV

SEQ ID NO: 6386 - protein, 11 aa, synthetic construct
  REGION 1..11: note = Synthetic
HCVALCTRGGH

SEQ ID NO: 6387 - protein, 11 aa, synthetic construct
  REGION 1..11: note = Synthetic
IHKYGASVSNG

SEQ ID NO: 6388 - protein, 12 aa, synthetic construct
  REGION 1..12: note = Synthetic
FQEAYRRFYGPV

SEQ ID NO: 6389 - protein, 12 aa, synthetic construct
  REGION 1..12: note = Synthetic
FKDALARVYGVI

SEQ ID NO: 6390 - protein, 12 aa, synthetic construct
  REGION 1..12: note = Synthetic
NMLGGGGSAGRK

SEQ ID NO: 6391 - protein, 12 aa, synthetic construct
  REGION 1..12: note = Synthetic
IVSIFNTLLKLA

SEQ ID NO: 6392 - protein, 12 aa, synthetic construct
  REGION 1..12: note = Synthetic
GGCSHGSRCLRD

SEQ ID NO: 6393 - protein, 12 aa, synthetic construct
  REGION 1..12: note = Synthetic
TWVRDVVRSMDR

SEQ ID NO: 6394 - protein, 12 aa, synthetic construct
  REGION 1..12: note = Synthetic
TWVRDVVRSMDR

SEQ ID NO: 6395 - protein, 11 aa, synthetic construct
  REGION 1..11: note = Synthetic
ALGRELASLFR

SEQ ID NO: 6396 - protein, 11 aa, synthetic construct
  REGION 1..11: note = Synthetic
YSALANKCCHV

SEQ ID NO: 6397 - protein, 11 aa, synthetic construct
  REGION 1..11: note = Synthetic
LKSMAGSGHNV

SEQ ID NO: 6398 - protein, 12 aa, synthetic construct
  REGION 1..12: note = Synthetic
IIRSFANSGNAI

SEQ ID NO: 6399 - protein, 11 aa, synthetic construct
  REGION 1..11: note = Synthetic
LKSFSTLANNF

SEQ ID NO: 6400 - protein, 12 aa, synthetic construct
  REGION 1..12: note = Synthetic
IKKAGTELVNFL

SEQ ID NO: 6401 - protein, 11 aa, synthetic construct
  REGION 1..11: note = Synthetic
FKTCWRAAPEF

SEQ ID NO: 6402 - protein, 12 aa, synthetic construct
  REGION 1..12: note = Synthetic
IVTIINTFLKLA

SEQ ID NO: 6403 - protein, 12 aa, synthetic construct
  REGION 1..12: note = Synthetic
LGGLLGKVTSVI

SEQ ID NO: 6404 - protein, 11 aa, synthetic construct
  REGION 1..11: note = Synthetic
ALLKALYGHGQ

SEQ ID NO: 6405 - protein, 12 aa, synthetic construct
  REGION 1..12: note = Synthetic
IVTIINTLLRLA

SEQ ID NO: 6406 - protein, 12 aa, synthetic construct
  REGION 1..12: note = Synthetic
IVTIFNTLLKIA

SEQ ID NO: 6407 - protein, 12 aa, synthetic construct
  REGION 1..12: note = Synthetic
IVTIINTLLKLA

SEQ ID NO: 6408 - protein, 12 aa, synthetic construct
  REGION 1..12: note = Synthetic
IVTIINTLLKLA

SEQ ID NO: 6409 - protein, 12 aa, synthetic construct
  REGION 1..12: note = Synthetic
IVTIINTLLKLA

SEQ ID NO: 6410 - protein, 12 aa, synthetic construct
  REGION 1..12: note = Synthetic
IVTIINTLLKLA

SEQ ID NO: 6411 - protein, 12 aa, synthetic construct
  REGION 1..12: note = Synthetic
IVTIINTLLKLA

SEQ ID NO: 6412 - protein, 12 aa, synthetic construct
  REGION 1..12: note = Synthetic
IVTIINTLLKLA

SEQ ID NO: 6413 - protein, 12 aa, synthetic construct
  REGION 1..12: note = Synthetic
IVTIINTLLKLA

SEQ ID NO: 6414 - protein, 11 aa, synthetic construct
  REGION 1..11: note = Synthetic
CQTVVRNIQSF

SEQ ID NO: 6415 - protein, 12 aa, synthetic construct
  REGION 1..12: note = Synthetic
FIRQYFTVFDRA

SEQ ID NO: 6416 - protein, 12 aa, synthetic construct
  REGION 1..12: note = Synthetic
FIRQYFTVFDRA

SEQ ID NO: 6417 - protein, 12 aa, synthetic construct
  REGION 1..12: note = Synthetic
FIRQYFTVFDRA

SEQ ID NO: 6418 - protein, 11 aa, synthetic construct
  REGION 1..11: note = Synthetic
RYGKVWSDYVG

SEQ ID NO: 6419 - protein, 12 aa, synthetic construct
  REGION 1..12: note = Synthetic
YIQEARNCLQKL

SEQ ID NO: 6420 - protein, 12 aa, synthetic construct
  REGION 1..12: note = Synthetic
YGQYLERLKQFV

SEQ ID NO: 6421 - protein, 11 aa, synthetic construct
  REGION 1..11: note = Synthetic
TYIRKALEDIR

SEQ ID NO: 6422 - protein, 11 aa, synthetic construct
  REGION 1..11: note = Synthetic
VTSARTALGRA

SEQ ID NO: 6423 - protein, 11 aa, synthetic construct
  REGION 1..11: note = Synthetic
ECNKIIQKALS

SEQ ID NO: 6424 - protein, 11 aa, synthetic construct
  REGION 1..11: note = Synthetic
SYLGRFYQDLK

SEQ ID NO: 6425 - protein, 12 aa, synthetic construct
  REGION 1..12: note = Synthetic
EFMQRALQDLRK

SEQ ID NO: 6426 - protein, 12 aa, synthetic construct
  REGION 1..12: note = Synthetic
LRTVPGALGAWL

SEQ ID NO: 6427 - protein, 12 aa, synthetic construct
  REGION 1..12: note = Synthetic
VSSLVKSIGNSY

SEQ ID NO: 6428 - protein, 12 aa, synthetic construct
  REGION 1..12: note = Synthetic
APRCGDKIYNPL

SEQ ID NO: 6429 - protein, 11 aa, synthetic construct
  REGION 1..11: note = Synthetic
EWLRRYLENGK

SEQ ID NO: 6430 - protein, 12 aa, synthetic construct
  REGION 1..12: note = Synthetic
WLQKWYGGASSI

SEQ ID NO: 6431 - protein, 11 aa, synthetic construct
  REGION 1..11: note = Synthetic
AGAIGRAGPRG

SEQ ID NO: 6432 - protein, 12 aa, synthetic construct
  REGION 1..12: note = Synthetic
KMYTGLCNFVER

SEQ ID NO: 6433 - protein, 11 aa, synthetic construct
  REGION 1..11: note = Synthetic
SFVSSLVRSIS

SEQ ID NO: 6434 - protein, 12 aa, synthetic construct
  REGION 1..12: note = Synthetic
CGSIIAKILAGY

SEQ ID NO: 6435 - protein, 12 aa, synthetic construct
  REGION 1..12: note = Synthetic
HQLRSLAGTYLN

SEQ ID NO: 6436 - protein, 11 aa, synthetic construct
  REGION 1..11: note = Synthetic
CNRAMSGINNY

SEQ ID NO: 6437 - protein, 12 aa, synthetic construct
  REGION 1..12: note = Synthetic
CRSLCEAVRAGC

SEQ ID NO: 6438 - protein, 11 aa, synthetic construct
  REGION 1..11: note = Synthetic
IAKVGQLFAAW

SEQ ID NO: 6439 - protein, 11 aa, synthetic construct
  REGION 1..11: note = Synthetic
ARVFAHGAATL

SEQ ID NO: 6440 - protein, 12 aa, synthetic construct
  REGION 1..12: note = Synthetic
VSRMVSTMLSGL

SEQ ID NO: 6441 - protein, 11 aa, synthetic construct
  REGION 1..11: note = Synthetic
RMYSEIIALMK

SEQ ID NO: 6442 - protein, 11 aa, synthetic construct
  REGION 1..11: note = Synthetic
QLGQALNGVYR

SEQ ID NO: 6443 - protein, 12 aa, synthetic construct
  REGION 1..12: note = Synthetic
RAVASGCQRCCD

SEQ ID NO: 6444 - protein, 12 aa, synthetic construct
  REGION 1..12: note = Synthetic
VVTIINTLLKLA

SEQ ID NO: 6445 - protein, 12 aa, synthetic construct
  REGION 1..12: note = Synthetic
KLFSDLGSSYAK

SEQ ID NO: 6446 - protein, 12 aa, synthetic construct
  REGION 1..12: note = Synthetic
IIATLKNGVQTC

SEQ ID NO: 6447 - protein, 12 aa, synthetic construct
  REGION 1..12: note = Synthetic
ISQASSCLQKLL

SEQ ID NO: 6448 - protein, 12 aa, synthetic construct
  REGION 1..12: note = Synthetic
HGAMGAFRALCG

SEQ ID NO: 6449 - protein, 11 aa, synthetic construct
  REGION 1..11: note = Synthetic
ASCGGRAGGRC

SEQ ID NO: 6450 - protein, 12 aa, synthetic construct
  REGION 1..12: note = Synthetic
YKQIIAVLAQAF

SEQ ID NO: 6451 - protein, 11 aa, synthetic construct
  REGION 1..11: note = Synthetic
FTALVTQCQKM

SEQ ID NO: 6452 - protein, 12 aa, synthetic construct
  REGION 1..12: note = Synthetic
RSWVEKIVQGVQ

SEQ ID NO: 6453 - protein, 12 aa, synthetic construct
  REGION 1..12: note = Synthetic
MAQYAADLRRYI

SEQ ID NO: 6454 - protein, 12 aa, synthetic construct
  REGION 1..12: note = Synthetic
LLQAAPRGAAHY

SEQ ID NO: 6455 - protein, 11 aa, synthetic construct
  REGION 1..11: note = Synthetic
TIFNTLLKLAG

SEQ ID NO: 6456 - protein, 12 aa, synthetic construct
  REGION 1..12: note = Synthetic
YQGMCRNACREY

SEQ ID NO: 6457 - protein, 11 aa, synthetic construct
  REGION 1..11: note = Synthetic
VARFYAAAMHV

SEQ ID NO: 6458 - protein, 12 aa, synthetic construct
  REGION 1..12: note = Synthetic
SLFSSVFSSCQR

SEQ ID NO: 6459 - protein, 12 aa, synthetic construct
  REGION 1..12: note = Synthetic
SLFSSVFSSCQR

SEQ ID NO: 6460 - protein, 12 aa, synthetic construct
  REGION 1..12: note = Synthetic
RGLMQSLPTFIQ

SEQ ID NO: 6461 - protein, 12 aa, synthetic construct
  REGION 1..12: note = Synthetic
ASTGWNSVSRII

SEQ ID NO: 6462 - protein, 12 aa, synthetic construct
  REGION 1..12: note = Synthetic
LRAGAQQGLSRA

SEQ ID NO: 6463 - protein, 12 aa, synthetic construct
  REGION 1..12: note = Synthetic
RKMAGEMAEGLR

SEQ ID NO: 6464 - protein, 12 aa, synthetic construct
  REGION 1..12: note = Synthetic
LRSGVQQLIQYY

SEQ ID NO: 6465 - protein, 11 aa, synthetic construct
  REGION 1..11: note = Synthetic
ASAILNRMQNI

SEQ ID NO: 6466 - protein, 12 aa, synthetic construct
  REGION 1..12: note = Synthetic
CGKSLPGVYTNV

SEQ ID NO: 6467 - protein, 12 aa, synthetic construct
  REGION 1..12: note = Synthetic
RICTPMGKLGDS

SEQ ID NO: 6468 - protein, 11 aa, synthetic construct
  REGION 1..11: note = Synthetic
GVYTKVCKYVD

SEQ ID NO: 6469 - protein, 12 aa, synthetic construct
  REGION 1..12: note = Synthetic
VTGIITQGARNF

SEQ ID NO: 6470 - protein, 11 aa, synthetic construct
  REGION 1..11: note = Synthetic
GVPGVYTNLCK

SEQ ID NO: 6471 - protein, 12 aa, synthetic construct
  REGION 1..12: note = Synthetic
CQSVAASCARSC

SEQ ID NO: 6472 - protein, 12 aa, synthetic construct
  REGION 1..12: note = Synthetic
ACNSAMSIINKY

SEQ ID NO: 6473 - protein, 12 aa, synthetic construct
  REGION 1..12: note = Synthetic
LSHYYASLCHYL

SEQ ID NO: 6474 - protein, 11 aa, synthetic construct
  REGION 1..11: note = Synthetic
GEAFGKKWCSL

SEQ ID NO: 6475 - protein, 11 aa, synthetic construct
  REGION 1..11: note = Synthetic
SLVRDGCGCCK

SEQ ID NO: 6476 - protein, 11 aa, synthetic construct
  REGION 1..11: note = Synthetic
GLVRDGCGCCK

SEQ ID NO: 6477 - protein, 11 aa, synthetic construct
  REGION 1..11: note = Synthetic
GYPGVYTNLCK

SEQ ID NO: 6478 - protein, 11 aa, synthetic construct
  REGION 1..11: note = Synthetic
GKNISTYLTQV

SEQ ID NO: 6479 - protein, 12 aa, synthetic construct
  REGION 1..12: note = Synthetic
ILKRGPGVGEGL

SEQ ID NO: 6480 - protein, 12 aa, synthetic construct
  REGION 1..12: note = Synthetic
SLISPLAQAVRS

SEQ ID NO: 6481 - protein, 11 aa, synthetic construct
  REGION 1..11: note = Synthetic
RVVSGAANVIG

SEQ ID NO: 6482 - protein, 11 aa, synthetic construct
  REGION 1..11: note = Synthetic
MREYMHHLLAL

SEQ ID NO: 6483 - protein, 12 aa, synthetic construct
  REGION 1..12: note = Synthetic
SGGNFLTGLGHR

SEQ ID NO: 6484 - protein, 12 aa, synthetic construct
  REGION 1..12: note = Synthetic
KQLYNKYPDAVA

SEQ ID NO: 6485 - protein, 11 aa, synthetic construct
  REGION 1..11: note = Synthetic
KGFQCCSSFCG

SEQ ID NO: 6486 - protein, 12 aa, synthetic construct
  REGION 1..12: note = Synthetic
NIASKLPDAAAK

SEQ ID NO: 6487 - protein, 11 aa, synthetic construct
  REGION 1..11: note = Synthetic
LTHCASAFPHL

SEQ ID NO: 6488 - protein, 11 aa, synthetic construct
  REGION 1..11: note = Synthetic
QAANEWGRSGK

SEQ ID NO: 6489 - protein, 12 aa, synthetic construct
  REGION 1..12: note = Synthetic
NCWATGWGLVSK

SEQ ID NO: 6490 - protein, 11 aa, synthetic construct
  REGION 1..11: note = Synthetic
GLLSGWARNGT

SEQ ID NO: 6491 - protein, 12 aa, synthetic construct
  REGION 1..12: note = Synthetic
LLAWCAGACRGA

SEQ ID NO: 6492 - protein, 12 aa, synthetic construct
  REGION 1..12: note = Synthetic
VYTHGCGCVRSA

SEQ ID NO: 6493 - protein, 11 aa, synthetic construct
  REGION 1..11: note = Synthetic
GQQMFQGVKSI

SEQ ID NO: 6494 - protein, 12 aa, synthetic construct
  REGION 1..12: note = Synthetic
RNCRELLSQGAT

SEQ ID NO: 6495 - protein, 11 aa, synthetic construct
  REGION 1..11: note = Synthetic
VGRAAGLLSGL

SEQ ID NO: 6496 - protein, 11 aa, synthetic construct
  REGION 1..11: note = Synthetic
GTILGRWCGSG

SEQ ID NO: 6497 - protein, 12 aa, synthetic construct
  REGION 1..12: note = Synthetic
AAALGKALCALL

SEQ ID NO: 6498 - protein, 11 aa, synthetic construct
  REGION 1..11: note = Synthetic
VALISKLGTAV

SEQ ID NO: 6499 - protein, 12 aa, synthetic construct
  REGION 1..12: note = Synthetic
AKAAMTELKSCI

SEQ ID NO: 6500 - protein, 12 aa, synthetic construct
  REGION 1..12: note = Synthetic
RYCAGACEAAAR

SEQ ID NO: 6501 - protein, 11 aa, synthetic construct
  REGION 1..11: note = Synthetic
QGCSIYKDYYR

SEQ ID NO: 6502 - protein, 12 aa, synthetic construct
  REGION 1..12: note = Synthetic
ASALGSWKAFLG

SEQ ID NO: 6503 - protein, 11 aa, synthetic construct
  REGION 1..11: note = Synthetic
AANAQKWANQC

SEQ ID NO: 6504 - protein, 12 aa, synthetic construct
  REGION 1..12: note = Synthetic
VAKQCSAGCAAM

SEQ ID NO: 6505 - protein, 11 aa, synthetic construct
  REGION 1..11: note = Synthetic
TYYSIIGGGLR

SEQ ID NO: 6506 - protein, 11 aa, synthetic construct
  REGION 1..11: note = Synthetic
ACRRCMGDAGA

SEQ ID NO: 6507 - protein, 11 aa, synthetic construct
  REGION 1..11: note = Synthetic
GSTGTQLCKAL

SEQ ID NO: 6508 - protein, 11 aa, synthetic construct
  REGION 1..11: note = Synthetic
QVAKAGGTWLG

SEQ ID NO: 6509 - protein, 11 aa, synthetic construct
  REGION 1..11: note = Synthetic
NGLAFISSGLK

SEQ ID NO: 6510 - protein, 11 aa, synthetic construct
  REGION 1..11: note = Synthetic
GEKAITQVSKG

SEQ ID NO: 6511 - protein, 12 aa, synthetic construct
  REGION 1..12: note = Synthetic
GALSTMVQLYSR

SEQ ID NO: 6512 - protein, 11 aa, synthetic construct
  REGION 1..11: note = Synthetic
GARGCNGIPGA

SEQ ID NO: 6513 - protein, 11 aa, synthetic construct
  REGION 1..11: note = Synthetic
VAKFYAAAMNA

SEQ ID NO: 6514 - protein, 11 aa, synthetic construct
  REGION 1..11: note = Synthetic
QAIRAAQGLLA

SEQ ID NO: 6515 - protein, 12 aa, synthetic construct
  REGION 1..12: note = Synthetic
GSFVAPVRGVYS

SEQ ID NO: 6516 - protein, 11 aa, synthetic construct
  REGION 1..11: note = Synthetic
KAYNSCISQGS

SEQ ID NO: 6517 - protein, 12 aa, synthetic construct
  REGION 1..12: note = Synthetic
REGAERGLSAIR

SEQ ID NO: 6518 - protein, 11 aa, synthetic construct
  REGION 1..11: note = Synthetic
QLLAGGLHAGK

SEQ ID NO: 6519 - protein, 11 aa, synthetic construct
  REGION 1..11: note = Synthetic
ALLRAAGSLAA

SEQ ID NO: 6520 - protein, 11 aa, synthetic construct
  REGION 1..11: note = Synthetic
KMASGAANVVG

SEQ ID NO: 6521 - protein, 11 aa, synthetic construct
  REGION 1..11: note = Synthetic
GVAQGIVSYGR

SEQ ID NO: 6522 - protein, 12 aa, synthetic construct
  REGION 1..12: note = Synthetic
ALARCPGCGQGV

SEQ ID NO: 6523 - protein, 12 aa, synthetic construct
  REGION 1..12: note = Synthetic
TAYRTALSHGHQ

SEQ ID NO: 6524 - protein, 11 aa, synthetic construct
  REGION 1..11: note = Synthetic
SGLAFISSGLK

SEQ ID NO: 6525 - protein, 11 aa, synthetic construct
  REGION 1..11: note = Synthetic
AYPGVGSALGR

SEQ ID NO: 6526 - protein, 12 aa, synthetic construct
  REGION 1..12: note = Synthetic
LPAGGGTVLTKM

SEQ ID NO: 6527 - protein, 11 aa, synthetic construct
  REGION 1..11: note = Synthetic
LERAASRANTV

SEQ ID NO: 6528 - protein, 11 aa, synthetic construct
  REGION 1..11: note = Synthetic
QAGDTIFNRAK

SEQ ID NO: 6529 - protein, 11 aa, synthetic construct
  REGION 1..11: note = Synthetic
VARFYAAAMSG

SEQ ID NO: 6530 - protein, 11 aa, synthetic construct
  REGION 1..11: note = Synthetic
SFAGNGLSALR

SEQ ID NO: 6531 - protein, 11 aa, synthetic construct
  REGION 1..11: note = Synthetic
MKHLDQIFQNL

SEQ ID NO: 6532 - protein, 12 aa, synthetic construct
  REGION 1..12: note = Synthetic
AARGTNVGRECC

SEQ ID NO: 6533 - protein, 12 aa, synthetic construct
  REGION 1..12: note = Synthetic
GIQGGSRCLACV

SEQ ID NO: 6534 - protein, 12 aa, synthetic construct
  REGION 1..12: note = Synthetic
LTAGVSAGRQMI

SEQ ID NO: 6535 - protein, 11 aa, synthetic construct
  REGION 1..11: note = Synthetic
AGRGETCYRTV

SEQ ID NO: 6536 - protein, 12 aa, synthetic construct
  REGION 1..12: note = Synthetic
MAAASAGATRLL

SEQ ID NO: 6537 - protein, 12 aa, synthetic construct
  REGION 1..12: note = Synthetic
CAAAAGRAGGSC

SEQ ID NO: 6538 - protein, 12 aa, synthetic construct
  REGION 1..12: note = Synthetic
GAGGGGCRGVDR

SEQ ID NO: 6539 - protein, 11 aa, synthetic construct
  REGION 1..11: note = Synthetic
AEGAFRRGPGL

SEQ ID NO: 6540 - protein, 11 aa, synthetic construct
  REGION 1..11: note = Synthetic
DYRGGGRTVIQ

SEQ ID NO: 6541 - protein, 12 aa, synthetic construct
  REGION 1..12: note = Synthetic
GSHVAQACVGHC

SEQ ID NO: 6542 - protein, 11 aa, synthetic construct
  REGION 1..11: note = Synthetic
AERGARNALGG

SEQ ID NO: 6543 - protein, 12 aa, synthetic construct
  REGION 1..12: note = Synthetic
VQKAAQAAVASY

SEQ ID NO: 6544 - protein, 11 aa, synthetic construct
  REGION 1..11: note = Synthetic
HAVSNACALGK

SEQ ID NO: 6545 - protein, 12 aa, synthetic construct
  REGION 1..12: note = Synthetic
IRDLYHYITSYV

SEQ ID NO: 6546 - protein, 12 aa, synthetic construct
  REGION 1..12: note = Synthetic
IRDLYHYITSYV

SEQ ID NO: 6547 - protein, 11 aa, synthetic construct
  REGION 1..11: note = Synthetic
ELHRALERLAA

SEQ ID NO: 6548 - protein, 11 aa, synthetic construct
  REGION 1..11: note = Synthetic
RFFSAAAAPAA

SEQ ID NO: 6549 - protein, 12 aa, synthetic construct
  REGION 1..12: note = Synthetic
GYLNRIHELLNG

SEQ ID NO: 6550 - protein, 11 aa, synthetic construct
  REGION 1..11: note = Synthetic
KGQGACQTYCT

SEQ ID NO: 6551 - protein, 11 aa, synthetic construct
  REGION 1..11: note = Synthetic
YSNFISHLANI

SEQ ID NO: 6552 - protein, 11 aa, synthetic construct
  REGION 1..11: note = Synthetic
YHTGLHTGHSF

SEQ ID NO: 6553 - protein, 12 aa, synthetic construct
  REGION 1..12: note = Synthetic
HEMLQQIFSLFR

SEQ ID NO: 6554 - protein, 11 aa, synthetic construct
  REGION 1..11: note = Synthetic
AHCIGGFWREV

SEQ ID NO: 6555 - protein, 11 aa, synthetic construct
  REGION 1..11: note = Synthetic
MRQYGECLHSC

SEQ ID NO: 6556 - protein, 11 aa, synthetic construct
  REGION 1..11: note = Synthetic
VTSGKEFYGRG

SEQ ID NO: 6557 - protein, 12 aa, synthetic construct
  REGION 1..12: note = Synthetic
RCGDKFYDPLQH

SEQ ID NO: 6558 - protein, 11 aa, synthetic construct
  REGION 1..11: note = Synthetic
TWAGKMYGPGG

SEQ ID NO: 6559 - protein, 12 aa, synthetic construct
  REGION 1..12: note = Synthetic
LAGCLSQLHSGL

SEQ ID NO: 6560 - protein, 11 aa, synthetic construct
  REGION 1..11: note = Synthetic
KLKDAFSHVVE

SEQ ID NO: 6561 - protein, 12 aa, synthetic construct
  REGION 1..12: note = Synthetic
LRHYCEPYTTWC

SEQ ID NO: 6562 - protein, 11 aa, synthetic construct
  REGION 1..11: note = Synthetic
HAVATACSLGK

SEQ ID NO: 6563 - protein, 12 aa, synthetic construct
  REGION 1..12: note = Synthetic
IIHVVATLLSTL

SEQ ID NO: 6564 - protein, 12 aa, synthetic construct
  REGION 1..12: note = Synthetic
LKECGHAYSGIV

SEQ ID NO: 6565 - protein, 11 aa, synthetic construct
  REGION 1..11: note = Synthetic
NAYSGILGIWH

SEQ ID NO: 6566 - protein, 12 aa, synthetic construct
  REGION 1..12: note = Synthetic
HLATSALSLLTH

SEQ ID NO: 6567 - protein, 11 aa, synthetic construct
  REGION 1..11: note = Synthetic
KVYEGAHRAVE

SEQ ID NO: 6568 - protein, 11 aa, synthetic construct
  REGION 1..11: note = Synthetic
ANGYVEHLFRY

SEQ ID NO: 6569 - protein, 11 aa, synthetic construct
  REGION 1..11: note = Synthetic
HMLTHLAEALH

SEQ ID NO: 6570 - protein, 11 aa, synthetic construct
  REGION 1..11: note = Synthetic
LHHLIAEIHTA

SEQ ID NO: 6571 - protein, 12 aa, synthetic construct
  REGION 1..12: note = Synthetic
LTSGVHTFPAVL

SEQ ID NO: 6572 - protein, 11 aa, synthetic construct
  REGION 1..11: note = Synthetic
GYCRTCCHWGE

SEQ ID NO: 6573 - protein, 11 aa, synthetic construct
  REGION 1..11: note = Synthetic
GHKVCTSCCEG

SEQ ID NO: 6574 - protein, 11 aa, synthetic construct
  REGION 1..11: note = Synthetic
GVYTKVCHYLE

SEQ ID NO: 6575 - protein, 11 aa, synthetic construct
  REGION 1..11: note = Synthetic
GQWYHTCGGSL

SEQ ID NO: 6576 - protein, 11 aa, synthetic construct
  REGION 1..11: note = Synthetic
GQAACGRAASG

SEQ ID NO: 6577 - protein, 11 aa, synthetic construct
  REGION 1..11: note = Synthetic
GALARAGAAGA

SEQ ID NO: 6578 - protein, 12 aa, synthetic construct
  REGION 1..12: note = Synthetic
HGLLASATNWIS

SEQ ID NO: 6579 - protein, 11 aa, synthetic construct
  REGION 1..11: note = Synthetic
AGLRLVGEAFH

SEQ ID NO: 6580 - protein, 12 aa, synthetic construct
  REGION 1..12: note = Synthetic
AFMASLATHFSN

SEQ ID NO: 6581 - protein, 11 aa, synthetic construct
  REGION 1..11: note = Synthetic
AAASSVAKGGA

SEQ ID NO: 6582 - protein, 12 aa, synthetic construct
  REGION 1..12: note = Synthetic
EGAKTGIKECQH

SEQ ID NO: 6583 - protein, 12 aa, synthetic construct
  REGION 1..12: note = Synthetic
ICAVGHGVAALC

SEQ ID NO: 6584 - protein, 11 aa, synthetic construct
  REGION 1..11: note = Synthetic
VTHVFGSGTQL

SEQ ID NO: 6585 - protein, 12 aa, synthetic construct
  REGION 1..12: note = Synthetic
AAGVAHAITAAC

SEQ ID NO: 6586 - protein, 12 aa, synthetic construct
  REGION 1..12: note = Synthetic
VFQTGKTGATTG

SEQ ID NO: 6587 - protein, 12 aa, synthetic construct
  REGION 1..12: note = Synthetic
GGGGPGTGWGTR

SEQ ID NO: 6588 - protein, 11 aa, synthetic construct
  REGION 1..11: note = Synthetic
ASALWAAAWHG

SEQ ID NO: 6589 - protein, 11 aa, synthetic construct
  REGION 1..11: note = Synthetic
AMGDRGMQLMH

SEQ ID NO: 6590 - protein, 11 aa, synthetic construct
  REGION 1..11: note = Synthetic
GVAHAVTAACS

SEQ ID NO: 6591 - protein, 11 aa, synthetic construct
  REGION 1..11: note = Synthetic
GVAHAVTAACS

SEQ ID NO: 6592 - protein, 11 aa, synthetic construct
  REGION 1..11: note = Synthetic
VHAIASAGVAF

SEQ ID NO: 6593 - protein, 11 aa, synthetic construct
  REGION 1..11: note = Synthetic
VHAIASAGVAF

SEQ ID NO: 6594 - protein, 12 aa, synthetic construct
  REGION 1..12: note = Synthetic
LWAALGAAAHIG

SEQ ID NO: 6595 - protein, 11 aa, synthetic construct
  REGION 1..11: note = Synthetic
AGRGGAAAPTA

SEQ ID NO: 6596 - protein, 12 aa, synthetic construct
  REGION 1..12: note = Synthetic
THAGGTGPEGCR

SEQ ID NO: 6597 - protein, 12 aa, synthetic construct
  REGION 1..12: note = Synthetic
GTAAAPAQGGAH

SEQ ID NO: 6598 - protein, 12 aa, synthetic construct
  REGION 1..12: note = Synthetic
GTAAAPAQGGAH

SEQ ID NO: 6599 - protein, 12 aa, synthetic construct
  REGION 1..12: note = Synthetic
GTAAAPAQGGAH

SEQ ID NO: 6600 - protein, 11 aa, synthetic construct
  REGION 1..11: note = Synthetic
LTNAIKDALAA

SEQ ID NO: 6601 - protein, 12 aa, synthetic construct
  REGION 1..12: note = Synthetic
FFESVYGQCKAI

SEQ ID NO: 6602 - protein, 11 aa, synthetic construct
  REGION 1..11: note = Synthetic
LTGLLGTLVTM

SEQ ID NO: 6603 - protein, 12 aa, synthetic construct
  REGION 1..12: note = Synthetic
MKNLLNRIIDDM

SEQ ID NO: 6604 - protein, 11 aa, synthetic construct
  REGION 1..11: note = Synthetic
LAQVGAKGDTA

SEQ ID NO: 6605 - protein, 12 aa, synthetic construct
  REGION 1..12: note = Synthetic
LLGGWMALGQGG

SEQ ID NO: 6606 - protein, 12 aa, synthetic construct
  REGION 1..12: note = Synthetic
SRLLSVGGEAFS

SEQ ID NO: 6607 - protein, 11 aa, synthetic construct
  REGION 1..11: note = Synthetic
AGAIIGTLLAL

SEQ ID NO: 6608 - protein, 12 aa, synthetic construct
  REGION 1..12: note = Synthetic
VFAVFSAAASNW

SEQ ID NO: 6609 - protein, 12 aa, synthetic construct
  REGION 1..12: note = Synthetic
VFAVFSAAASNW

SEQ ID NO: 6610 - protein, 12 aa, synthetic construct
  REGION 1..12: note = Synthetic
FGGTVYRSGESF

SEQ ID NO: 6611 - protein, 12 aa, synthetic construct
  REGION 1..12: note = Synthetic
NQWYTVCQTGWS

SEQ ID NO: 6612 - protein, 12 aa, synthetic construct
  REGION 1..12: note = Synthetic
TLASSYASWIQS

SEQ ID NO: 6613 - protein, 11 aa, synthetic construct
  REGION 1..11: note = Synthetic
ARFAAGVAEQF

SEQ ID NO: 6614 - protein, 12 aa, synthetic construct
  REGION 1..12: note = Synthetic
CQKICEPLGGYY

SEQ ID NO: 6615 - protein, 11 aa, synthetic construct
  REGION 1..11: note = Synthetic
FGAILGAILGV

SEQ ID NO: 6616 - protein, 12 aa, synthetic construct
  REGION 1..12: note = Synthetic
LISRISSVGGEA

SEQ ID NO: 6617 - protein, 11 aa, synthetic construct
  REGION 1..11: note = Synthetic
GTTGSGAGSGG

SEQ ID NO: 6618 - protein, 12 aa, synthetic construct
  REGION 1..12: note = Synthetic
RYIDFCESGLSR

SEQ ID NO: 6619 - protein, 12 aa, synthetic construct
  REGION 1..12: note = Synthetic
AFAGYSGLLAGV

SEQ ID NO: 6620 - protein, 12 aa, synthetic construct
  REGION 1..12: note = Synthetic
LVTTALTMGREI

SEQ ID NO: 6621 - protein, 11 aa, synthetic construct
  REGION 1..11: note = Synthetic
AHFYGHCGEQL

SEQ ID NO: 6622 - protein, 11 aa, synthetic construct
  REGION 1..11: note = Synthetic
IQSFEQVGTKV

SEQ ID NO: 6623 - protein, 11 aa, synthetic construct
  REGION 1..11: note = Synthetic
ELNQAVRTGGG

SEQ ID NO: 6624 - protein, 12 aa, synthetic construct
  REGION 1..12: note = Synthetic
AGVISWGEGCAR

SEQ ID NO: 6625 - protein, 12 aa, synthetic construct
  REGION 1..12: note = Synthetic
IRGFIDKIAENV

SEQ ID NO: 6626 - protein, 12 aa, synthetic construct
  REGION 1..12: note = Synthetic
KAGQLISELFTN

SEQ ID NO: 6627 - protein, 11 aa, synthetic construct
  REGION 1..11: note = Synthetic
SCYSAGIAKLE

SEQ ID NO: 6628 - protein, 11 aa, synthetic construct
  REGION 1..11: note = Synthetic
AGSWGAQIIGG

SEQ ID NO: 6629 - protein, 12 aa, synthetic construct
  REGION 1..12: note = Synthetic
TFLEDLKSFVKS

SEQ ID NO: 6630 - protein, 12 aa, synthetic construct
  REGION 1..12: note = Synthetic
SLCQPGQKLVSD

SEQ ID NO: 6631 - protein, 11 aa, synthetic construct
  REGION 1..11: note = Synthetic
AAELRNFLRDL

SEQ ID NO: 6632 - protein, 11 aa, synthetic construct
  REGION 1..11: note = Synthetic
NVSQGCQGGCA

SEQ ID NO: 6633 - protein, 12 aa, synthetic construct
  REGION 1..12: note = Synthetic
LLAAYAGPAQSL

SEQ ID NO: 6634 - protein, 12 aa, synthetic construct
  REGION 1..12: note = Synthetic
LISRISSVGGEA

SEQ ID NO: 6635 - protein, 11 aa, synthetic construct
  REGION 1..11: note = Synthetic
AASLGSQGSGL

SEQ ID NO: 6636 - protein, 12 aa, synthetic construct
  REGION 1..12: note = Synthetic
ALTQVEAAITRG

SEQ ID NO: 6637 - protein, 11 aa, synthetic construct
  REGION 1..11: note = Synthetic
GSQACAKGCEL

SEQ ID NO: 6638 - protein, 11 aa, synthetic construct
  REGION 1..11: note = Synthetic
AGASGVSSCMG

SEQ ID NO: 6639 - protein, 11 aa, synthetic construct
  REGION 1..11: note = Synthetic
AGASGVSSCMG

SEQ ID NO: 6640 - protein, 12 aa, synthetic construct
  REGION 1..12: note = Synthetic
LCEGVFRGVTSF

SEQ ID NO: 6641 - protein, 12 aa, synthetic construct
  REGION 1..12: note = Synthetic
EKLIQNIKEMVT

SEQ ID NO: 6642 - protein, 12 aa, synthetic construct
  REGION 1..12: note = Synthetic
HKGWDFVEGYFH

SEQ ID NO: 6643 - protein, 12 aa, synthetic construct
  REGION 1..12: note = Synthetic
ELYRVVESLAKA

SEQ ID NO: 6644 - protein, 11 aa, synthetic construct
  REGION 1..11: note = Synthetic
GAGGSGAISTA

SEQ ID NO: 6645 - protein, 12 aa, synthetic construct
  REGION 1..12: note = Synthetic
GWGDFYSNIKTV

SEQ ID NO: 6646 - protein, 12 aa, synthetic construct
  REGION 1..12: note = Synthetic
KSVCEVGSNWFQ

SEQ ID NO: 6647 - protein, 12 aa, synthetic construct
  REGION 1..12: note = Synthetic
WLSWGAALGAVA

SEQ ID NO: 6648 - protein, 12 aa, synthetic construct
  REGION 1..12: note = Synthetic
CARRLGEPCDQL

SEQ ID NO: 6649 - protein, 12 aa, synthetic construct
  REGION 1..12: note = Synthetic
GVVSGGAEPCSR

SEQ ID NO: 6650 - protein, 11 aa, synthetic construct
  REGION 1..11: note = Synthetic
CGGVLQGLVSW

SEQ ID NO: 6651 - protein, 12 aa, synthetic construct
  REGION 1..12: note = Synthetic
LISGWGNTLSSG

SEQ ID NO: 6652 - protein, 12 aa, synthetic construct
  REGION 1..12: note = Synthetic
SLISGWGNTLSS

SEQ ID NO: 6653 - protein, 12 aa, synthetic construct
  REGION 1..12: note = Synthetic
KALLDNCFRVME

SEQ ID NO: 6654 - protein, 11 aa, synthetic construct
  REGION 1..11: note = Synthetic
CNGMLQGILSF

SEQ ID NO: 6655 - protein, 12 aa, synthetic construct
  REGION 1..12: note = Synthetic
WIRDMYAKVTEI

SEQ ID NO: 6656 - protein, 12 aa, synthetic construct
  REGION 1..12: note = Synthetic
CQNGGTCVAQAM

SEQ ID NO: 6657 - protein, 12 aa, synthetic construct
  REGION 1..12: note = Synthetic
VFASLCAWYSGY

SEQ ID NO: 6658 - protein, 11 aa, synthetic construct
  REGION 1..11: note = Synthetic
YSRAFGEGASA

SEQ ID NO: 6659 - protein, 12 aa, synthetic construct
  REGION 1..12: note = Synthetic
AAAFGPGQTLLS

SEQ ID NO: 6660 - protein, 12 aa, synthetic construct
  REGION 1..12: note = Synthetic
LLASCVAAGQAV

SEQ ID NO: 6661 - protein, 12 aa, synthetic construct
  REGION 1..12: note = Synthetic
LLASCVAAGQAV

SEQ ID NO: 6662 - protein, 12 aa, synthetic construct
  REGION 1..12: note = Synthetic
LLASCVAAGQAV

SEQ ID NO: 6663 - protein, 12 aa, synthetic construct
  REGION 1..12: note = Synthetic
LLATLLRPADAC

SEQ ID NO: 6664 - protein, 12 aa, synthetic construct
  REGION 1..12: note = Synthetic
GAALVSSACGGC

SEQ ID NO: 6665 - protein, 12 aa, synthetic construct
  REGION 1..12: note = Synthetic
GIQTLMRRLEDG

SEQ ID NO: 6666 - protein, 11 aa, synthetic construct
  REGION 1..11: note = Synthetic
MDKVETFLRTV

SEQ ID NO: 6667 - protein, 12 aa, synthetic construct
  REGION 1..12: note = Synthetic
CLAYFTSGFNAA

SEQ ID NO: 6668 - protein, 11 aa, synthetic construct
  REGION 1..11: note = Synthetic
AERLGNTCERA

SEQ ID NO: 6669 - protein, 12 aa, synthetic construct
  REGION 1..12: note = Synthetic
RDLLDTASALYR

SEQ ID NO: 6670 - protein, 12 aa, synthetic construct
  REGION 1..12: note = Synthetic
AGGAGVNPATQG

SEQ ID NO: 6671 - protein, 12 aa, synthetic construct
  REGION 1..12: note = Synthetic
AVGERAGQLWSQ

SEQ ID NO: 6672 - protein, 11 aa, synthetic construct
  REGION 1..11: note = Synthetic
KVPELYKDILS

SEQ ID NO: 6673 - protein, 11 aa, synthetic construct
  REGION 1..11: note = Synthetic
DCISRGGTLGT

SEQ ID NO: 6674 - protein, 11 aa, synthetic construct
  REGION 1..11: note = Synthetic
GRNGYTAVIEV

SEQ ID NO: 6675 - protein, 11 aa, synthetic construct
  REGION 1..11: note = Synthetic
GESGTSGWRGG

SEQ ID NO: 6676 - protein, 12 aa, synthetic construct
  REGION 1..12: note = Synthetic
LASEGLKHFHEA

SEQ ID NO: 6677 - protein, 12 aa, synthetic construct
  REGION 1..12: note = Synthetic
AHVMSVLHEMLQ

SEQ ID NO: 6678 - protein, 12 aa, synthetic construct
  REGION 1..12: note = Synthetic
SILDQILQNIGR

SEQ ID NO: 6679 - protein, 11 aa, synthetic construct
  REGION 1..11: note = Synthetic
DFCNDVLARAK

SEQ ID NO: 6680 - protein, 11 aa, synthetic construct
  REGION 1..11: note = Synthetic
KLYTELYQQLN

SEQ ID NO: 6681 - protein, 11 aa, synthetic construct
  REGION 1..11: note = Synthetic
KFYTELYQQLN

SEQ ID NO: 6682 - protein, 11 aa, synthetic construct
  REGION 1..11: note = Synthetic
KFCTELYQQLN

SEQ ID NO: 6683 - protein, 11 aa, synthetic construct
  REGION 1..11: note = Synthetic
KFYTELYQQLN

SEQ ID NO: 6684 - protein, 12 aa, synthetic construct
  REGION 1..12: note = Synthetic
RKGLSELDTLFS

SEQ ID NO: 6685 - protein, 12 aa, synthetic construct
  REGION 1..12: note = Synthetic
RKGLSELDTLFS

SEQ ID NO: 6686 - protein, 11 aa, synthetic construct
  REGION 1..11: note = Synthetic
WNGVGASLWAA

SEQ ID NO: 6687 - protein, 12 aa, synthetic construct
  REGION 1..12: note = Synthetic
REALEEFKKLVQ

SEQ ID NO: 6688 - protein, 12 aa, synthetic construct
  REGION 1..12: note = Synthetic
NIVEAMERFGSR

SEQ ID NO: 6689 - protein, 12 aa, synthetic construct
  REGION 1..12: note = Synthetic
LASQGLGPGSTV

SEQ ID NO: 6690 - protein, 12 aa, synthetic construct
  REGION 1..12: note = Synthetic
TLFSSIFTEAQK

SEQ ID NO: 6691 - protein, 12 aa, synthetic construct
  REGION 1..12: note = Synthetic
GCGVGTGAADKA

SEQ ID NO: 6692 - protein, 11 aa, synthetic construct
  REGION 1..11: note = Synthetic
LEAIVKAGITI

SEQ ID NO: 6693 - protein, 12 aa, synthetic construct
  REGION 1..12: note = Synthetic
RAISQGVAEWTA

SEQ ID NO: 6694 - protein, 12 aa, synthetic construct
  REGION 1..12: note = Synthetic
TVGGGVFALVTA

SEQ ID NO: 6695 - protein, 12 aa, synthetic construct
  REGION 1..12: note = Synthetic
SAGSTVYAPFTG

SEQ ID NO: 6696 - protein, 12 aa, synthetic construct
  REGION 1..12: note = Synthetic
ALTCLGGFASPG

SEQ ID NO: 6697 - protein, 11 aa, synthetic construct
  REGION 1..11: note = Synthetic
GKEGMGAWPTW

SEQ ID NO: 6698 - protein, 12 aa, synthetic construct
  REGION 1..12: note = Synthetic
QVMAAYQQIVGG

SEQ ID NO: 6699 - protein, 11 aa, synthetic construct
  REGION 1..11: note = Synthetic
LAALVQNYVQM

SEQ ID NO: 6700 - protein, 11 aa, synthetic construct
  REGION 1..11: note = Synthetic
LDDILQRLVKL

SEQ ID NO: 6701 - protein, 12 aa, synthetic construct
  REGION 1..12: note = Synthetic
SGAIGPVEAAIR

SEQ ID NO: 6702 - protein, 11 aa, synthetic construct
  REGION 1..11: note = Synthetic
LAALVQNYVQM

SEQ ID NO: 6703 - protein, 12 aa, synthetic construct
  REGION 1..12: note = Synthetic
GRMKELLETVVN

SEQ ID NO: 6704 - protein, 11 aa, synthetic construct
  REGION 1..11: note = Synthetic
TFMGCLKNCAD

SEQ ID NO: 6705 - protein, 12 aa, synthetic construct
  REGION 1..12: note = Synthetic
NNIMRTIIEFLS

SEQ ID NO: 6706 - protein, 12 aa, synthetic construct
  REGION 1..12: note = Synthetic
LFALLAAGVAPL

SEQ ID NO: 6707 - protein, 12 aa, synthetic construct
  REGION 1..12: note = Synthetic
EWVQRYMKNLDA

SEQ ID NO: 6708 - protein, 12 aa, synthetic construct
  REGION 1..12: note = Synthetic
LLGAWAALAGGV

SEQ ID NO: 6709 - protein, 12 aa, synthetic construct
  REGION 1..12: note = Synthetic
RAISQGVAEWTA

SEQ ID NO: 6710 - protein, 11 aa, synthetic construct
  REGION 1..11: note = Synthetic
QCCTSICSLYQ

SEQ ID NO: 6711 - protein, 11 aa, synthetic construct
  REGION 1..11: note = Synthetic
QCCTSICSLYQ

SEQ ID NO: 6712 - protein, 11 aa, synthetic construct
  REGION 1..11: note = Synthetic
TGCTCGSACGS

SEQ ID NO: 6713 - protein, 11 aa, synthetic construct
  REGION 1..11: note = Synthetic
AAGASVATELR

SEQ ID NO: 6714 - protein, 12 aa, synthetic construct
  REGION 1..12: note = Synthetic
KKGTNYLADVFE

SEQ ID NO: 6715 - protein, 12 aa, synthetic construct
  REGION 1..12: note = Synthetic
LSSYWESAKTAA

SEQ ID NO: 6716 - protein, 12 aa, synthetic construct
  REGION 1..12: note = Synthetic
LVTPVRTLATEA

SEQ ID NO: 6717 - protein, 12 aa, synthetic construct
  REGION 1..12: note = Synthetic
MAAALALVAGVL

SEQ ID NO: 6718 - protein, 11 aa, synthetic construct
  REGION 1..11: note = Synthetic
QCCTSICSLYQ

SEQ ID NO: 6719 - protein, 11 aa, synthetic construct
  REGION 1..11: note = Synthetic
LKWIQEYLEKA

SEQ ID NO: 6720 - protein, 11 aa, synthetic construct
  REGION 1..11: note = Synthetic
KWVREYINSLE

SEQ ID NO: 6721 - protein, 12 aa, synthetic construct
  REGION 1..12: note = Synthetic
VSSALDKLKEFG

SEQ ID NO: 6722 - protein, 11 aa, synthetic construct
  REGION 1..11: note = Synthetic
SGNTGADSLGR

SEQ ID NO: 6723 - protein, 11 aa, synthetic construct
  REGION 1..11: note = Synthetic
GGGGGAAGGAE

SEQ ID NO: 6724 - protein, 12 aa, synthetic construct
  REGION 1..12: note = Synthetic
QIAAHVISEASS

SEQ ID NO: 6725 - protein, 11 aa, synthetic construct
  REGION 1..11: note = Synthetic
AAPAAEGVGAA

SEQ ID NO: 6726 - protein, 11 aa, synthetic construct
  REGION 1..11: note = Synthetic
FHFAADCCTSY

SEQ ID NO: 6727 - protein, 11 aa, synthetic construct
  REGION 1..11: note = Synthetic
DFGAGVAGHLG

SEQ ID NO: 6728 - protein, 11 aa, synthetic construct
  REGION 1..11: note = Synthetic
VDQGATGASQG

SEQ ID NO: 6729 - protein, 12 aa, synthetic construct
  REGION 1..12: note = Synthetic
RNGHEYYGDYYQ

SEQ ID NO: 6730 - protein, 12 aa, synthetic construct
  REGION 1..12: note = Synthetic
AQAISVLHEMMQ

SEQ ID NO: 6731 - protein, 12 aa, synthetic construct
  REGION 1..12: note = Synthetic
AAALHNLDEAVK

SEQ ID NO: 6732 - protein, 12 aa, synthetic construct
  REGION 1..12: note = Synthetic
DGWSHFPTCYNS

SEQ ID NO: 6733 - protein, 12 aa, synthetic construct
  REGION 1..12: note = Synthetic
AQAISVLHEMIQ

SEQ ID NO: 6734 - protein, 12 aa, synthetic construct
  REGION 1..12: note = Synthetic
AQAISVLHEMIQ

SEQ ID NO: 6735 - protein, 12 aa, synthetic construct
  REGION 1..12: note = Synthetic
AQAISVLHEMIQ

SEQ ID NO: 6736 - protein, 12 aa, synthetic construct
  REGION 1..12: note = Synthetic
AQAISVLHEMIQ

SEQ ID NO: 6737 - protein, 11 aa, synthetic construct
  REGION 1..11: note = Synthetic
AAAVVSHFNDC

SEQ ID NO: 6738 - protein, 12 aa, synthetic construct
  REGION 1..12: note = Synthetic
TQAISVLHEMIQ

SEQ ID NO: 6739 - protein, 12 aa, synthetic construct
  REGION 1..12: note = Synthetic
TQAISVLHEMIQ

SEQ ID NO: 6740 - protein, 12 aa, synthetic construct
  REGION 1..12: note = Synthetic
QTVKTICDEVLH

SEQ ID NO: 6741 - protein, 12 aa, synthetic construct
  REGION 1..12: note = Synthetic
AQAISAFHEMIQ

SEQ ID NO: 6742 - protein, 12 aa, synthetic construct
  REGION 1..12: note = Synthetic
SVLTSLLEAFAH

SEQ ID NO: 6743 - protein, 12 aa, synthetic construct
  REGION 1..12: note = Synthetic
THFGEPLEKVAS

SEQ ID NO: 6744 - protein, 12 aa, synthetic construct
  REGION 1..12: note = Synthetic
LEGLGQQVGSHF

SEQ ID NO: 6745 - protein, 12 aa, synthetic construct
  REGION 1..12: note = Synthetic
RSYCHPIETLVD

SEQ ID NO: 6746 - protein, 12 aa, synthetic construct
  REGION 1..12: note = Synthetic
RTCLHYLGEFGE

SEQ ID NO: 6747 - protein, 11 aa, synthetic construct
  REGION 1..11: note = Synthetic
GGQASGWCSEG

SEQ ID NO: 6748 - protein, 12 aa, synthetic construct
  REGION 1..12: note = Synthetic
RAGLQEGDQVLA

SEQ ID NO: 6749 - protein, 12 aa, synthetic construct
  REGION 1..12: note = Synthetic
ELAADGVGAASR

SEQ ID NO: 6750 - protein, 11 aa, synthetic construct
  REGION 1..11: note = Synthetic
QCLDVVTHWIQ

SEQ ID NO: 6751 - protein, 12 aa, synthetic construct
  REGION 1..12: note = Synthetic
IEDMARTFFAHF

SEQ ID NO: 6752 - protein, 11 aa, synthetic construct
  REGION 1..11: note = Synthetic
ALAAAAQDAIG

SEQ ID NO: 6753 - protein, 12 aa, synthetic construct
  REGION 1..12: note = Synthetic
SAGQTLGSEYDR

SEQ ID NO: 6754 - protein, 11 aa, synthetic construct
  REGION 1..11: note = Synthetic
GHDLSEWLKGC

SEQ ID NO: 6755 - protein, 11 aa, synthetic construct
  REGION 1..11: note = Synthetic
IETIINTFHQY

SEQ ID NO: 6756 - protein, 12 aa, synthetic construct
  REGION 1..12: note = Synthetic
QTMATKAPECVE

SEQ ID NO: 6757 - protein, 12 aa, synthetic construct
  REGION 1..12: note = Synthetic
KTAFQEALDAAG

SEQ ID NO: 6758 - protein, 12 aa, synthetic construct
  REGION 1..12: note = Synthetic
RQAATMLEEAAS

SEQ ID NO: 6759 - protein, 11 aa, synthetic construct
  REGION 1..11: note = Synthetic
GAPGKDGYDGL

SEQ ID NO: 6760 - protein, 12 aa, synthetic construct
  REGION 1..12: note = Synthetic
AGVVSWGEGCAQ

SEQ ID NO: 6761 - protein, 12 aa, synthetic construct
  REGION 1..12: note = Synthetic
AGVVSWGEGCAQ

SEQ ID NO: 6762 - protein, 11 aa, synthetic construct
  REGION 1..11: note = Synthetic
LQSGDTLGASW

SEQ ID NO: 6763 - protein, 12 aa, synthetic construct
  REGION 1..12: note = Synthetic
GLGAGERWADLA

SEQ ID NO: 6764 - protein, 12 aa, synthetic construct
  REGION 1..12: note = Synthetic
ALSAMENLITYA

SEQ ID NO: 6765 - protein, 12 aa, synthetic construct
  REGION 1..12: note = Synthetic
AGAEVFSGLSSL

SEQ ID NO: 6766 - protein, 11 aa, synthetic construct
  REGION 1..11: note = Synthetic
GQDGAQAGVDG

SEQ ID NO: 6767 - protein, 12 aa, synthetic construct
  REGION 1..12: note = Synthetic
GTIQGGLQDGLQ

SEQ ID NO: 6768 - protein, 12 aa, synthetic construct
  REGION 1..12: note = Synthetic
GVGDYIGIYASI

SEQ ID NO: 6769 - protein, 12 aa, synthetic construct
  REGION 1..12: note = Synthetic
TAIWNGGQDIVA

SEQ ID NO: 6770 - protein, 11 aa, synthetic construct
  REGION 1..11: note = Synthetic
TMKEVLEQAGA

SEQ ID NO: 6771 - protein, 12 aa, synthetic construct
  REGION 1..12: note = Synthetic
VDTVFNTVWTLG

SEQ ID NO: 6772 - protein, 12 aa, synthetic construct
  REGION 1..12: note = Synthetic
SELKDFGTEAAR

SEQ ID NO: 6773 - protein, 11 aa, synthetic construct
  REGION 1..11: note = Synthetic
DGFKAVVGDAQ

SEQ ID NO: 6774 - protein, 12 aa, synthetic construct
  REGION 1..12: note = Synthetic
SQATDFGEALVR

SEQ ID NO: 6775 - protein, 11 aa, synthetic construct
  REGION 1..11: note = Synthetic
GSSGGDNGEEG

SEQ ID NO: 6776 - protein, 11 aa, synthetic construct
  REGION 1..11: note = Synthetic
VTDISGGCGAM

SEQ ID NO: 6777 - protein, 11 aa, synthetic construct
  REGION 1..11: note = Synthetic
QLPSGCQAGLD

SEQ ID NO: 6778 - protein, 12 aa, synthetic construct
  REGION 1..12: note = Synthetic
TCVEVASELGKS

SEQ ID NO: 6779 - protein, 12 aa, synthetic construct
  REGION 1..12: note = Synthetic
GMEGANSIFSGF

SEQ ID NO: 6780 - protein, 11 aa, synthetic construct
  REGION 1..11: note = Synthetic
LAALVQDYVQM

SEQ ID NO: 6781 - protein, 11 aa, synthetic construct
  REGION 1..11: note = Synthetic
MAEVGGVFASL

SEQ ID NO: 6782 - protein, 11 aa, synthetic construct
  REGION 1..11: note = Synthetic
EGVKEGIEKAG

SEQ ID NO: 6783 - protein, 11 aa, synthetic construct
  REGION 1..11: note = Synthetic
ASTIAEYISGY

SEQ ID NO: 6784 - protein, 12 aa, synthetic construct
  REGION 1..12: note = Synthetic
SQLLKDIDGYGG

SEQ ID NO: 6785 - protein, 11 aa, synthetic construct
  REGION 1..11: note = Synthetic
AEPAADGVGAA

SEQ ID NO: 6786 - protein, 11 aa, synthetic construct
  REGION 1..11: note = Synthetic
AEPAADGVGAA

SEQ ID NO: 6787 - protein, 11 aa, synthetic construct
  REGION 1..11: note = Synthetic
AEPAADGVGAA

SEQ ID NO: 6788 - protein, 11 aa, synthetic construct
  REGION 1..11: note = Synthetic
AEPAADGVGAA

SEQ ID NO: 6789 - protein, 11 aa, synthetic construct
  REGION 1..11: note = Synthetic
AEPAADGVGAA

SEQ ID NO: 6790 - protein, 11 aa, synthetic construct
  REGION 1..11: note = Synthetic
AEPAADGVGAA

SEQ ID NO: 6791 - protein, 11 aa, synthetic construct
  REGION 1..11: note = Synthetic
AEPAADGVGAA

SEQ ID NO: 6792 - protein, 11 aa, synthetic construct
  REGION 1..11: note = Synthetic
GDYYGDLAARL

SEQ ID NO: 6793 - protein, 11 aa, synthetic construct
  REGION 1..11: note = Synthetic
LSSAFDGVSGL

SEQ ID NO: 6794 - protein, 11 aa, synthetic construct
  REGION 1..11: note = Synthetic
GVFGGIGDPVT

SEQ ID NO: 6795 - protein, 11 aa, synthetic construct
  REGION 1..11: note = Synthetic
CQALGSEITGF

SEQ ID NO: 6796 - protein, 12 aa, synthetic construct
  REGION 1..12: note = Synthetic
GIQTLMGRLEDG

SEQ ID NO: 6797 - protein, 12 aa, synthetic construct
  REGION 1..12: note = Synthetic
GIQTLMGRLEDG

SEQ ID NO: 6798 - protein, 12 aa, synthetic construct
  REGION 1..12: note = Synthetic
GIQTLMGRLEDG

SEQ ID NO: 6799 - protein, 12 aa, synthetic construct
  REGION 1..12: note = Synthetic
GIQTLMGRLEDG

SEQ ID NO: 6800 - protein, 12 aa, synthetic construct
  REGION 1..12: note = Synthetic
GIQTLMGRLEDG

SEQ ID NO: 6801 - protein, 12 aa, synthetic construct
  REGION 1..12: note = Synthetic
GIQTLMGRLEDG

SEQ ID NO: 6802 - protein, 11 aa, synthetic construct
  REGION 1..11: note = Synthetic
SVCTVAGDGGE

SEQ ID NO: 6803 - protein, 12 aa, synthetic construct
  REGION 1..12: note = Synthetic
TSWSSAIQSWYD

SEQ ID NO: 6804 - protein, 11 aa, synthetic construct
  REGION 1..11: note = Synthetic
CGSVDGVIKEV

SEQ ID NO: 6805 - protein, 12 aa, synthetic construct
  REGION 1..12: note = Synthetic
IAAVVDVIRELG

SEQ ID NO: 6806 - protein, 11 aa, synthetic construct
  REGION 1..11: note = Synthetic
LGEMVTRLPDG

SEQ ID NO: 6807 - protein, 11 aa, synthetic construct
  REGION 1..11: note = Synthetic
EAMENFMQQLK

SEQ ID NO: 6808 - protein, 11 aa, synthetic construct
  REGION 1..11: note = Synthetic
WNSLSSVFTEM

SEQ ID NO: 6809 - protein, 11 aa, synthetic construct
  REGION 1..11: note = Synthetic
AEPAADGVGAV

SEQ ID NO: 6810 - protein, 11 aa, synthetic construct
  REGION 1..11: note = Synthetic
AEPAADGVGAV

SEQ ID NO: 6811 - protein, 11 aa, synthetic construct
  REGION 1..11: note = Synthetic
AEPAADGVGAV

SEQ ID NO: 6812 - protein, 11 aa, synthetic construct
  REGION 1..11: note = Synthetic
AEPAADGVGAV

SEQ ID NO: 6813 - protein, 11 aa, synthetic construct
  REGION 1..11: note = Synthetic
AEPAADGVGAV

SEQ ID NO: 6814 - protein, 11 aa, synthetic construct
  REGION 1..11: note = Synthetic
AEPAADGVGAV

SEQ ID NO: 6815 - protein, 11 aa, synthetic construct
  REGION 1..11: note = Synthetic
AEPAADGVGAV

SEQ ID NO: 6816 - protein, 12 aa, synthetic construct
  REGION 1..12: note = Synthetic
GEWLGAWNNCFT

SEQ ID NO: 6817 - protein, 12 aa, synthetic construct
  REGION 1..12: note = Synthetic
QDCTKVYKDLLE

SEQ ID NO: 6818 - protein, 11 aa, synthetic construct
  REGION 1..11: note = Synthetic
FQSLKEFMDAC

SEQ ID NO: 6819 - protein, 11 aa, synthetic construct
  REGION 1..11: note = Synthetic
IDGGCAEGPGG

SEQ ID NO: 6820 - protein, 11 aa, synthetic construct
  REGION 1..11: note = Synthetic
ASEIGSDLFAG

SEQ ID NO: 6821 - protein, 12 aa, synthetic construct
  REGION 1..12: note = Synthetic
YQELFDQGCHPY

SEQ ID NO: 6822 - protein, 12 aa, synthetic construct
  REGION 1..12: note = Synthetic
CGSDYITYGNEC

SEQ ID NO: 6823 - protein, 12 aa, synthetic construct
  REGION 1..12: note = Synthetic
GLDDFLRQVERL

SEQ ID NO: 6824 - protein, 11 aa, synthetic construct
  REGION 1..11: note = Synthetic
GSDMSTYANEC

SEQ ID NO: 6825 - protein, 11 aa, synthetic construct
  REGION 1..11: note = Synthetic
AEPVAEGVGAV

SEQ ID NO: 6826 - protein, 12 aa, synthetic construct
  REGION 1..12: note = Synthetic
GSEADSVFSGFL

SEQ ID NO: 6827 - protein, 12 aa, synthetic construct
  REGION 1..12: note = Synthetic
TDYSDCIHEAIK

SEQ ID NO: 6828 - protein, 11 aa, synthetic construct
  REGION 1..11: note = Synthetic
LGEVNTYAGDL

SEQ ID NO: 6829 - protein, 12 aa, synthetic construct
  REGION 1..12: note = Synthetic
HLLKDLEEGIQT

SEQ ID NO: 6830 - protein, 12 aa, synthetic construct
  REGION 1..12: note = Synthetic
HLLKDLEEGIQT

SEQ ID NO: 6831 - protein, 11 aa, synthetic construct
  REGION 1..11: note = Synthetic
EMNTILDNLAA

SEQ ID NO: 6832 - protein, 11 aa, synthetic construct
  REGION 1..11: note = Synthetic
CDQAWGSMLEV

SEQ ID NO: 6833 - protein, 11 aa, synthetic construct
  REGION 1..11: note = Synthetic
DVCADMVGTFT

SEQ ID NO: 6834 - protein, 12 aa, synthetic construct
  REGION 1..12: note = Synthetic
SEITSLITTILD

SEQ ID NO: 6835 - protein, 12 aa, synthetic construct
  REGION 1..12: note = Synthetic
SDITSLITTILD

SEQ ID NO: 6836 - protein, 12 aa, synthetic construct
  REGION 1..12: note = Synthetic
KAVIDEIFQGLD

SEQ ID NO: 6837 - protein, 11 aa, synthetic construct
  REGION 1..11: note = Synthetic
EWVQKYVSDLE

SEQ ID NO: 6838 - protein, 11 aa, synthetic construct
  REGION 1..11: note = Synthetic
EWVQKYVSDLE

SEQ ID NO: 6839 - protein, 11 aa, synthetic construct
  REGION 1..11: note = Synthetic
DCDDIYAQGYQ

SEQ ID NO: 6840 - protein, 11 aa, synthetic construct
  REGION 1..11: note = Synthetic
VEDAGRVLEGI

SEQ ID NO: 6841 - protein, 12 aa, synthetic construct
  REGION 1..12: note = Synthetic
RVMESLEGLLES

SEQ ID NO: 6842 - protein, 12 aa, synthetic construct
  REGION 1..12: note = Synthetic
IDTYQEFISSWG

SEQ ID NO: 6843 - protein, 12 aa, synthetic construct
  REGION 1..12: note = Synthetic
FEECLEKFFSTG

SEQ ID NO: 6844 - protein, 12 aa, synthetic construct
  REGION 1..12: note = Synthetic
SLAGELDEAMGS

SEQ ID NO: 6845 - protein, 12 aa, synthetic construct
  REGION 1..12: note = Synthetic
SLAGELDEAMGS

SEQ ID NO: 6846 - protein, 12 aa, synthetic construct
  REGION 1..12: note = Synthetic
CPALVSELLDFF

SEQ ID NO: 6847 - protein, 12 aa, synthetic construct
  REGION 1..12: note = Synthetic
LKDLEEGIQTLM

SEQ ID NO: 6848 - protein, 12 aa, synthetic construct
  REGION 1..12: note = Synthetic
LKDLEEGIQTLM

SEQ ID NO: 6849 - protein, 12 aa, synthetic construct
  REGION 1..12: note = Synthetic
LKDLEEGIQTLM

SEQ ID NO: 6850 - protein, 11 aa, synthetic construct
  REGION 1..11: note = Synthetic
GTEIIENAVEF

SEQ ID NO: 6851 - protein, 12 aa, synthetic construct
  REGION 1..12: note = Synthetic
EALEDFEKAAGA

SEQ ID NO: 6852 - protein, 12 aa, synthetic construct
  REGION 1..12: note = Synthetic
EALEDFEKAAGA

SEQ ID NO: 6853 - protein, 11 aa, synthetic construct
  REGION 1..11: note = Synthetic
YNPLEQCCDDG

SEQ ID NO: 6854 - protein, 12 aa, synthetic construct
  REGION 1..12: note = Synthetic
EDLLQEAQALAE

SEQ ID NO: 6855 - protein, 11 aa, synthetic construct
  REGION 1..11: note = Synthetic
LTDYGDQLPEV

SEQ ID NO: 6856 - protein, 12 aa, synthetic construct
  REGION 1..12: note = Synthetic
GALWDECCDCVG

SEQ ID NO: 6857 - protein, 12 aa, synthetic construct
  REGION 1..12: note = Synthetic
MGDCIGWLEDFL

SEQ ID NO: 6858 - protein, 12 aa, synthetic construct
  REGION 1..12: note = Synthetic
GVDGYVDNIEDL

SEQ ID NO: 6859 - protein, 11 aa, synthetic construct
  REGION 1..11: note = Synthetic
MDGYVDSIEDL

SEQ ID NO: 6860 - protein, 12 aa, synthetic construct
  REGION 1..12: note = Synthetic
AWEAMEELVDEG

SEQ ID NO: 6861 - skipped

SEQ ID NO: 6862 - protein, 7 aa, synthetic construct
  REGION 1..7: note = Synthetic
  SITE 2: note = MISC_FEATURE - Xaa is a string of 10-13 amino acids each being any naturally occuring amino acid
  SITE 4: note = MISC_FEATURE - Xaa is a string of 2-3 amino acids each being any naturally occuring amino acid
  SITE 6: note = MISC_FEATURE - Xaa is a string of 2 amino acids each being any naturally occuring amino acid
CXGXCXP

SEQ ID NO: 6863 - protein, 20 aa, synthetic construct
  REGION 1..20: note = Synthetic
CANTEIIVKLSDGRELCLDP

SEQ ID NO: 6864 - protein, 14 aa, synthetic construct
  REGION 1..14: note = Synthetic
  SITE 2: note = MISC_FEATURE - Xaa is a string of 4 amino acids each being any naturally occurring amino acid
  SITE 3: note = MISC_FEATURE - Xaa is a string of 3 amino acids each selected from A, F, I, L, V, W, Y
  SITE 4: note = MISC_FEATURE - Xaa is a string of 0-2 amino acid each being any naturally occurring amino acid
  SITE 6: note = MISC_FEATURE - Xaa is a string of 1-3 amino acid each being any naturally occurring amino acid
  SITE 9: note = MISC_FEATURE - Xaa is any amino acid selected from D, E, H, K, N, R, Q
  SITE 10: note = MISC_FEATURE - Xaa is any amino acid selected from A, F, I, L, V, W, Y
  SITE 12: note = MISC_FEATURE - Xaa is any amino acid selected from A, F, I, L, V, W, Y
CXXXKXGKXXCXDP

SEQ ID NO: 6865 - protein, 14 aa, synthetic construct
  REGION 1..14: note = Synthetic
  SITE 2: note = MISC_FEATURE - Xaa is a string of 4 amino acids each being any naturally occurring amino acid
  SITE 3: note = MISC_FEATURE - Xaa is a string of 3 amino acids each selected from A, F, I, L, V, W, Y
  SITE 4: note = MISC_FEATURE - Xaa is a string of 0-2 amino acids each being any naturally occurring amino acid
  SITE 6: note = MISC_FEATURE - Xaa is a string of 1-3 amino acids each being any naturally occurring amino acid
  SITE 9: note = MISC_FEATURE - Xaa is any amino acid selected from D, E, H, K, N, R, Q
  SITE 10: note = MISC_FEATURE - Xaa is any amino acid selected from A, F, I, L, V, W, Y
  SITE 12: note = MISC_FEATURE - Xaa is any amino acid selected from A, F, I, L, V, W, Y
CXXXRXGKXXCXNP

SEQ ID NO: 6866 - skipped

SEQ ID NO: 6867 - protein, 12 aa, synthetic construct
  REGION 1..12: note = Synthetic
DWMKTAGEWLKK

SEQ ID NO: 6868 - protein, 12 aa, synthetic construct
  REGION 1..12: note = Synthetic
AFRKIATVVKNL

SEQ ID NO: 6869 - protein, 12 aa, synthetic construct
  REGION 1..12: note = Synthetic
IEKVGQNIRDGI

SEQ ID NO: 6870 - protein, 12 aa, synthetic construct
  REGION 1..12: note = Synthetic
KTAGKRLKSLLN

SEQ ID NO: 6871 - protein, 12 aa, synthetic construct
  REGION 1..12: note = Synthetic
KVWDWIKSAAKK

SEQ ID NO: 6872 - protein, 12 aa, synthetic construct
  REGION 1..12: note = Synthetic
IGEEFKRIVQRI

SEQ ID NO: 6873 - protein, 12 aa, synthetic construct
  REGION 1..12: note = Synthetic
LDIFKDAAKQIL

SEQ ID NO: 6874 - protein, 12 aa, synthetic construct
  REGION 1..12: note = Synthetic
LDIFKDAAKQIL

SEQ ID NO: 6875 - protein, 12 aa, synthetic construct
  REGION 1..12: note = Synthetic
LWKTLLKNVGKA

SEQ ID NO: 6876 - protein, 12 aa, synthetic construct
  REGION 1..12: note = Synthetic
LERAGQRVRDAI

SEQ ID NO: 6877 - protein, 12 aa, synthetic construct
  REGION 1..12: note = Synthetic
ENFFKEIERAGQ

SEQ ID NO: 6878 - protein, 12 aa, synthetic construct
  REGION 1..12: note = Synthetic
QGLHEAIKLINN

SEQ ID NO: 6879 - protein, 12 aa, synthetic construct
  REGION 1..12: note = Synthetic
LLSSLSSVAKHV

SEQ ID NO: 6880 - protein, 12 aa, synthetic construct
  REGION 1..12: note = Synthetic
LDTLKNLAKTAG

SEQ ID NO: 6881 - protein, 12 aa, synthetic construct
  REGION 1..12: note = Synthetic
KKAAHVGKHVGK

SEQ ID NO: 6882 - protein, 12 aa, synthetic construct
  REGION 1..12: note = Synthetic
RIKKIVQKIMED

SEQ ID NO: 6883 - protein, 12 aa, synthetic construct
  REGION 1..12: note = Synthetic
LGKIIHHVGNFV

SEQ ID NO: 6884 - protein, 12 aa, synthetic construct
  REGION 1..12: note = Synthetic
QRVVEKFLKRAE

The invention claimed is:

1. A method for treating an infection in a patient in need thereof, comprising administering to the patient a polypeptide comprising the amino acid sequence of SEQ ID NO: 3, wherein the peptide is not longer than 60 amino acid residues in length.

2. The method of claim 1, wherein the peptide is not longer than 50 amino acid residues in length.

3. The method of claim 1, further comprising administering to the patient an antimicrobial agent.

4. The method of claim 3, wherein the antimicrobial agent is selected from the group consisting of imipenem, ceftazidime, colistin, chloroquine, artemisinin, vancomycin and daptomycin.

5. The method of claim 1, wherein the infection is caused by a Gram-negative bacterium.

6. The method of claim 1, wherein the infection is caused by a Gram-positive bacterium.

7. The method of claim 1, wherein the infection is caused by a fungus.

8. The method of claim 1, wherein the administration is subcutaneous, intravenous, intramuscular, intra-articular, intra-synovial, intrasternal, intrathecal, intrahepatic, intralesional, or intracranial injection, or infusion.

* * * * *